United States Patent 12,642,819 (COMPOSITIONS AND METHODS FOR TREATING INFLAMMATORY BOWEL DISEASE) - sequence listing, part 70

SEQ ID NO: 33 - DNA, 6524593 bp, Clostridium sp. (residues 4,349,731-6,524,593 of 6,524,593)
  modified_base (171050)..(171145): a, c, t, g, unknown or other
  modified_base (2275778)..(2275875): a, c, t, g, unknown or other
  modified_base (2873978)..(2874074): a, c, t, g, unknown or other
  modified_base (5848447)..(5848543): a, c, t, g, unknown or other
  modified_base (6448307)..(6448485): a, c, t, g, unknown or other
  modified_base (6461486)..(6461669): a, c, t, g, unknown or other
  modified_base (6464467)..(6464993): a, c, t, g, unknown or other
cttaagctcctccagatgggcgtaggcattctctatggacttgtactgggcgatgatgctggtagctgtcttttccccaatggaaggcacccccggtatgttgtcggaggaatcacccataagtgcctttacatcaatgaactcctccggcgttacctgatactcctgcatcacatccccggggtaataatccttaatctcggtcacgcctctgctggttctgggaatccgaatcttgatgtgctggtcagccagctgcagaaggtccctgtcgccggatacaacggatacctcaatgccctgggcctggcacctctttgccacggttcccagtatgtcgtccgcctcaaagccctccagggtcatgatgggaattcccatggccttgagcacttccttcatcaccggaacctgctcatgaagttcctcaggcatgggctttctcgtccccttataggcatcatacatctcatgccggaaggtcggctcctttaaatcaaaggcaaccgctgcatggtccgccttttcctcctccaatatcttcagcatgatatttaaaaaaccgtacactgcgttggtatgcagaccttccgaattcgtaaggtccggtaccccgtaaaatgcccggttcataatactgtgtccatcaatcaaaaccaatttgtccattaatatgagttcctttctgtctctgtcaccacatcctgaactgaagcaccagcaccaccagcacggcccagaagcacagggtgttcaccgcatagcgggctgtctccaggattcccagggtgtgcaccctctgccgggacagctccagggctgtctccagggctcccttgatgttataggtgcctgtttcctggtccagctggcggattccaacgtccactgtgaagtaaatctccagctcttccctgcattccccacaggtctcaatgtgttttaaaaattctttcagttcctcgtccgtaatgctgccgttgatatacggcattaccagacgctccgcttccctgcaggtcacagccggcacctcctgtctatcattttaatcaaattctccttacatcatacaataaatcagcttacttttcaatgaaagattgggactcccgggacctgattcagggccgcatccggagtcaggccccggcacggcccagacgccggaccgtctatcccttcctgtattccctgggagaaacgcctgtcagccgccggaatacatccccgaaataattgccgtccgagaatccgcaggccatggccacaccggtcacggaaaggtctgtgttgcgcagcaaatccgatgctttctgcacgcggatgtaattcagatactccttaaagcaaagaccggtggagcttttaaatttctttgaaaaataggtgggactcatgttggcaaatgcagccaccacccccagcgtcagcccttcctgataatgctggttcatatatctggctgccctgaccatggtttcctcggtctcctccagcatgtgcccgtccccgcgggcgccctggcagcgccctaatatgaccagaatctggtgaaggaggctgcgaagctgtatctggcagtagctgtccccctgcttttcctcatcctgcatctgtgccagcagttcctccgtctttgggcggaattccgggggaatggtccgtttgggctgtgaaaagatatggtcaaatgcatcctttccgcaaaggcttaaaaaggagctgaccgtgtcctttgaaaaatagacgccgaaccgttctgcctgccagtttggctcatacagcgccttgtggacctcaagaggagggatgatggtcatatcgcccggttccaggtagtagatatcctgattgataaacatcttgcatttcccggataacagataataaatctcataataagaatggtaatgagggcgcttcatcacaaaactggaggaccttctgatacggctgacctgaacgcttttatcctttaaaaccatggtgttgctcatacatgcattccctccttcatcttcgcctgcatccttcctctgcatggccggaccgccatggcaagaaaactgtaattttcgaaaaatatcccataaaatccgtattattccatctgtttttgttataccataaagccatccaaaggtaaacaatgaaatggaggaatgaccatgatacccatggctgtgatggttgccaataaaaaaagccgctgccttcgggaaacagccgccgaacaaaaaggcctgggcctggcggaggttcccatggaggaggccgatatcatatatcttccggattacagcagtctggatttccagcaggtccttgcacttctgagagcaggaaagcatgtcctgttcggtgccatgggagcagcggatgccggttccttaaggacgctggcacagacagcggatgagcacggcgcggtgctgctggaacatatccatcttgggtttaacccatgtatggctcccttaaagacagcagtcaaatgcctgggccccatacgccggattcgtctccattcctgtgagtacgccttcacctgcaagggaatccgcagcgcttttgtccatgctccggcccgccttctcccgggaggtgcactgtttcaaaggggattggactgcatctatcctcttgtgcatctctttggcataccggagcatctggatgcccggatggtgttcacggaaaacggaatggacgcagccggcgcagtcagcggatatctgggcgctgcccgggtggagctggtttattccaagatatccggcagccatgttcccagcctcatagagggagaaaagggaagcctgttaatccgtgatatacagaatttcagggaagtaacctatttcaaccgtttcgcggcagaggagccgctggtctccttttcagacaaagcctgccgcagcagggagctggaacagtgcatggaatatatagaaggaaaaagggactggcgcaggcacctcgcaacctccttcctggtctttcagatgatggatgaaatccgcggatgccggaatccggatgctggatatagaaatccattccaggggtcctgtgcgtctgccatttagatgcgtatagcggaacaaaccacaaaacacaaaaaaccgccgaatcccttgatttcatcaaggtttcaacggttttttcttatgccggcagcgggacttgaacccgcacgcggttacccgcaacagattttgagtctgcatcgtctgccattccgacacgccggcttacaacgctgattattttatcacaggatacatattttggcaagtgttttttgaaaaaacctgcgggactcttcacccctgaccggctgcgccgcaggctgacgggaatggacgggctggagaaagactgtcaggaccggctgctgcccattcccaacagtccccttctcacgtttgtcctaccggattgcctgctggccgctggccttgtatatttcataccactcataatgctccagccggaggtccagggccttgacggccatatccagacggtccgggcggttgctgccggaaatagggattgcccctgcgggatggtacataatccaggcatatatgacagtggctgggtctgtgtcatgtctctctgcaattttcttaatggttttcatggctgcggcgcagaggctgtcattggggtcaaacatccttccgcccgccagaggcgaccatatcatgggatggattccggacgcagtcaggtcgtccatcattcctgaattaaaatgctcaaagcagaccggattccactcaatctggttggttaccagctgtccgcccactgctttgttaaggccgtggaatttgtgggggtcaaagttggaaacgcccatctccccaatcttcccctccctcttaagctctgtcagggctctggccgtggactcaaaatcaatgcaggggtcctccctgtgaatcagatacaggtccagacggtctgtgtgaagccgcttcaggctttcctcacaggacttctttaccctgtcgtatcttgtgtcatagtatccgaacccattctcattgaaaattccggttttggataccagctggattcggtgccggatggaggcgtcctgttcaaaggcccggcccatcagtgtctcgcacagcgtgccgccgtagatttccgctgtgtcaaaggtggttaccccccgctcaatgcattcattcatgaaccgggccagctcctttgcagaccaattccagccgtccagtctccagaatccctgtaccacggctgacaatgacagcccttctgataatttgacttttttcaccttgttcctcctaattaagaattttttctcatatccagggcaacagcactgcatatgataagtccctttacaatcagctgccagttggagttaacccctatgtaggcaagtccatagctgatgaaggtaaatataagcacgcctatgataacgccggatacttttcccacgcctccgctcagggatacgcctcccaccacgcaggaggatatggcatcaaattcatatgcatttccatatgctgagttggcgcctccggtcctggccacttccaggataccggccagtcccacaaacatggattcaatgatgaacacagtgatgattaccctgctcacattgatgccggataccttggctgcctccgggttgcctcccacaatatatatgttcttcccgaacacggttttattgagcaggaaccataccccggcaatggcaatgatggcaatgaccaccagaaaggaaatctgcccgaataccttgaaactgctgagcacggtcaaatcctccctgatgcctccgatgggctgggaattgttgggcttcttggcaaaatacagacagttgattccgtatacaatggtgctcatgccgaatgtggcgataaagggggccatcttaagctttgcaatcatgaagccgttaatagctccaatcacggcaaccagtgccagggtcatgatgaccggaataatgatgggaagctcaggaaggcccggccagaacttgttggaatagtccaccatctgcgacagggacgccaccataacggccgccaggcccacctgacggccgccggacaggtcggtcccacctaaaagcagggcaaacatcagtcccaacgcacatatcattttaacggcagactgggtcagtatgtctgtcaaaacccttatctgcaaaaaagaaggttcaattatgatgattcctataatcataaataccagcacgatgataagggctttatccatcataatctgttttatgtcctttgctgtcaaatcctttcttttcataccgacactccttctttcgtcttatcgtcaaattgggtggcatacttcatcacctcaacctgggtggcttccttcctgccaaggatgccggtctgctttccggcacacataatcatgatgcggtccgacatccccagtaactccggcatctcagaggaaaccattatgattgcctttccctttttcactaaatcctgcatgattctgtaaatttcgtatttggctcccacatccacgcccctggtgggttcatccagcataatgacatcgcagtttgccagcagccatctgccaatcagcaccttttgctgattcccccccgacaggttcttgataagggtctttgtcccggccatgcggacatccaggtccgtacacaccttgtcaacgctgggagacagctttttcgcatggatgtatcccaagacattgccggtcagcttcttataggcaaccgccagggtgttgtcccataccgacagcatgggaatgattcccgttgccctgcgttcctctgtcagaagggcaaatccgttgcgtatggcgtcctggggagaatggttgaccactctttttccgttgacggacagctccccgcttacgattttgcgcaggccgaatatggcttctatcagctctgtcctctgtgctcccaccagcccgcctatgcccagtatctcgcccttatgcaggtcaaaggatacgttcttaaaggagcgcgggtccgcgctggtaaaattccttacctgcagcattatctcgtctgtcagggtcttttcacagacaggaaagcgctcgtccatcttcctgcccaccatctgcccaataagctggtctatggtaatgtccccgatatcccatgtgcctatgtactggccgtccctcatcacggttatctggtctgctatctcaaatatttcctccagcttgtgggatatgtagataatggaacgcccttccttcctcagcttgtcaatgattttgaacagatgccgggtttccgccacggtcagcgaggaagtgggctcgtccatgatgatgatttttgcattgtaggaaacagcctttgctatctcgattgcctgcatctgtgaaacagacaggttctttgcaaaggttgtcacgtctatatcaaaatccaaatcccgaagcaggttcctggtcttttccatcatctggttttcatccaccacaataccctttgtctggaacctgcccgcccatatattgtccaccacattccggtaaggaaccggattcagctcctggtgaatcatggaaatgccgcttttcagcgcatcgttggggtccttgatatccatgacccggccatcaatttcaatggtcccgctgtcaggatgatagaggccgaacagacacttcatcaaagtggatttgccggccccgttttcgccaatcaatgcatgtacacttccaggcttcaccgcaagcttaatattgtcaagggcttttactccggggaaggatttagacatgttttctatcttcagcctgtattcttccatctgcttcctccaggttccttattcggactgggccactgccagcatgtcctccagggttgcgcttaaattgctttcatcgacaatcacgtagggcacccatacatacttcccgtcaaccgtgcagtccacgccaaccacgtcctccgtgatttccgttcctgcatgcactgccttgattacattgataatggcgtcggactggctcttcctgtcattcagcacagtgcccagaagggaacctgccttcattgcctccagggcgtcaatatttgcgtcgattcctacaattggaacaaattttccggcatcccctgaattgtagccgttgttgatgcaagcctgcaccgcgcccatggccatggaatcgttgttgcagagaacgccttcaattccgtcgattccgtaggccgtaatccatgcgttcatcttatccagcgcctgggcctggtcccagttggctgtatcgcaggccagaatctcgtattcaatcccgttcttttccagggtttctttataggcatcggtacgcagggtaacgtcctgctggccgatttccccctgcaggataaccaactgaagcttgccgtccccgtttttatccgcaatgtcctttttgctgttccagtagttaatcagcgcctgggcgcacatttcacctgactgcttggcctgggcgcccacatagcagatgttgtcgtaccgtttcatggtatcttccattggctccatgttgaagaatacggccggcacgccgtctgcgtcgcatttcttcatcatgttctcaatgctctccctgtcaggcgcgcatatggcaaccacatccgttttcttgctcagggccacctctaatttggaattggccgtggatacgtcatttgcagcatcctgcatatcaagggtaataccgcccagcttctcggcctcgttctgcatgatgatgcgaaatccgctctggaactggtcgtcaaaagctctccagataacggtggccttcatatcctcccggacctccccctgctgtccggcgctctctgcatccctggctgtttcactgcctgccggcggcgctggctgtgtctccccctgacctccaaaacaggctgtcaatgttcccatcatcactgctgctgtcatcccacatacgattctgttcatactttttttcataagttatcttctccttttaatagattaatccatcagtgcaaattctctcattttccccttaatgaactccctggcgcaggcctgggaatttacaaacatgcctgtgttgtacttaaagtccggcttctgcttcatatccccaaaggaattggcaactgcaatcagtacatccgtagcaatgttgattttcctgatgccgttcctgatggcttcctgtacctgctccttaggagtgcctgagccgccgtgaagcacaatggggacatccactgcatcatggattttcttaagccgttcaatgttcaggtgtggagccgccacatacacaccgtgctgtgtcccgatgctgacagcaatgcagtcaatgcccgtgcgctccacgaattcctttgcctggtccgggtctgtctgggcggattcagggtcgccttccaccttgaagtttccttcttctcccaccagcttgcctaactcgccttccactgtgatgccgtaacagtgggcgtaatccgccacttttttggtcagagccacattttcctcaaagggcagggaggaaccgtctatcatgacagaggaatatccggcctgtatggcctgtacgcattcctcatatgtacggcagtggtccaggtgaagggcaacagggactttgcagtcagctgccttcatggccctcctgacggtttccacggttccctcaaaacctcccatcaaatcacagcagtccgtacccgtgataaagataaccggaatatccagctgggtccctgcttcaattgctgccagggcagtttcataggaaacagtcacataggcgccgtaggcaatgtttctctcctcagccatctgcaaaatgtctttcatcggtgataatttcatactcttttttctcctttatttatgatttttatgatgattgtataaatacaactcttctttatagggcaggatgccgtttgccgcccccatgtgctggacactgtgggaggcaaccgagcttcccagtgccgcactttcaaaaaatgtaagtccgttaatcatgcctgccaccagtccggccataaaggaatcacctgcccccgtggtgtccacggcccggattccccgggggcactctatgtattgctcactggtaaaatccgtggcatagcatccctttgcacccagctttattccaaaatatctgagccccagaggttttaaggccctgcggatttccggtatctccctgcatccggttatggccgacgcctcctcgtagcttgggaaaaaaatatccgtatagggcaggacttccttaaacatatccatccagcggcagcaggatgcccgctggttaaaggccgcatccataaccgtcatactgccctggttcctggcccttttaaggattctggcaagaccgccctggttcatccggttaaaactgcatgcagagccaatgtaaacaatatctgcattttccatggcttcctccggcaggtccctgtcatccacctcgtcaaaaatggatacatccgacagaaaatgccgttccccgttttcctcaatcagggcaaaactggaagcagtcgcatgaaccgggtcagtcaccacatgggaaacatcaattcccagggttctgcattggtccagaatgaaccttccgttcaggtcatctcccacccgccccgccattgtaacaggaatgcccaggcgcgataaaccaatagctgtattgagagcatccccgccgcaggcctgcaccggcttttctatcatggtgcagtctctgcttaagacatcccggtccacgggtcttaaaagggtatcgcacaccatcattccaaaactaagtaccaccttttaaaccacccctccttcatccatatgtccgtacatacatataattgcacaatgtgatatgtttgtcaagtacttgtggcaaaattatgataaaatgttattttttcaaattttctcttgcatttttcacaacatgctttacaatataattgatgtttcgtttgtacatacatatgcatctaaagctgaaaggattttaaattatgactatgttcacgaaagaaataaataaggatgtgcccattcccctttattaccagctgaaaaatatcatcaaaacagatattgaaaacggcaatctgaaaaccggggataccatccccaccgagatggaaatcatgagccattacagcatcagccgttttacggtgcgtcaggcgatttccgaactggtaaatgagggctacctggtcagaaagacgagcaaaggcacctttgttacggaacccaataaaaagaccagcttcatcaagtcctttgaacccttccaccagcaaatccaggaactgggcaagaccccgcacacggagctgttagatatgtccgtcatgacgccggacgaccgaatcaggggacttctccgccttggggccaatgagaaggttatatccctgttcagacggcgctttgcggattcaacgcctgtggtgacgattcagaattatcttccctacagcctctgccactttgtactgagtcatgactttaaggacgtatctctatacaatctcttcatgtcccggcccgaaacctgcattgacaatacccgtaccattgtctccgccgagacagccacgcctgaggatgtcaagctgctggaagtaaaaccaggcagccccatgctctgcttcaataatatttccaccaccagcgacggaaccataatcgactatgcctatgcccattaccgcggggatatgaataagtttgaaatcaacgaaagccccaaatacccccgttcataatacaatccgtcatatacccgcgcaaaaaagcagcgggaccggaataacatcatccggccccgctgctgcggttcccatatcttaatttttcccaaacacagaagctgtcttaatatccagcttcctgcaccactccttcagtacatcctccttatagaatgacacggaaaaatcctccaaatcatggtcaaggggtatgtctgtcttgatggtggccaattcctttgacagccttgcggctgcttccccgcacagttccccttcctcacctgttttagtcagggatttgtagggagaacggctgattcccaggctgttcttccagaagtcctgcagctccttcatctcctttttgtcctgctccgcctcatgtatcacctggtaaatgttctccacggtgccgtattcacccagcaaaagaggggctgcgctggcaacgcctctgactcccggaatgttgtcggaggtgtcgccctgtattcccttcaggtccgtaatctgctctggccacactccctcctcggagtacacggtttccgccgtaaactcaaaggttttttccggcaggtttaccgacgttttatccagaccgtaaagcccgtaatatttaccgtaaagctcctccgccttctcctgcctggcctggaccatccaggcccttacattgtacgcgtcgtttaccagctgcaggtagtcatggtccttggtcatcaccaccacaggtacctgctccctgaatttatagacaaggcttccggcgtaatcatccgcctcataccggtcgctgtagagcaccttaaagcctgcctcctccaaaatccgctccatcagcacaaactgctgcttaaggggctccggcgtcctgcttctggtgcccttatactcaggatacagctccctgcggaaggtatcccttgtcttgtcaaacacaaaggccatgtaggccggctgctgctttttcagcagggacgccacggccttcagcacccccatgatgccgttggtgtaggtcccgtccgatgcgtgaaggattttcccgtaatacttttccttctcctcgtcggtcttggcaaacataatttccctgggcagtactgcataataacaggttgacagcagggatgagccgtcaacaatcacgaattttctttctgacatcctgattccatctctttcttgcgtattctgtcattgcgcgggttctccatccttatctgcggtgatgcctgtcccagattcctgcaaacagcagggcggctacaatgaataccagcacaatcatccgttccatctgtcccatatggctcctcctcccggagacatgattttacccggaagtcacagcttcctcaagactgtatcatacaccagttttgtcctggcgtcaaagagaacccacagaatctcttccagctcacccggatgcccttctgtaaattccctggctgtcccaatggcggttttggctgccagctccaccgggaagtggtatatgccggtggagacagagggaaacgcaatccgcttcaccccgtgttccactgccagcaaaagggaattgcggtaacaggaggcaagcatttcctgctcattgtgctcccctccgttccacacagggccaaccgtgtggatgatgtacctgcagtccagattgtaagcctttgtaagcctggcctgtcctgtcttacagccgcctagcagcctgcactcatacagcagttcctttcccgcggccctgtggatggccccgtccacccctcctcctccaaggagggatgagttggccgcatttacgattgcatccattccggttatcttcgttatatcacctaatacagtacctatgactgtgtttttttcattcttcatggctggcctcctctgatacctttttttaattataccatataacccctcagtcctgacagcagtaattccccgatttttcctgccccgctgtcagccgcaaaggtatggaccagacaagccttatccctgcccaggatgttctccagttcagcaaaggaaagcaggcctttgagatacaattttacaatttccatgggtccgctgccgatttccgccaccagctctaaatgtgtcatgattcaccttctttctgcctttttcaaccctctgttaaaaatgccggcctaataatatatgcatgcattttccagaatattcctgctggcagccatttgattcctgtgaaatcatgaaaatctttcgttttacctatggtaaagattaatcattccattgaaaaaagtcagctttttgtaagaaacattacgcttcattacatttcgctgacttccgttgcaattcatcctgaactatggtatattcacatcaggtcagaaatgacgctagcccggcagcttccacagccccatgttgtggaagcgccgggctccccccaaaaagaattcttacccgaatctttgccgaaggtttcttccttcaaatcacggcccgttattcttcgtatttccagatttgcacctcacctgaatacccctcaaacgtacgcttaatgatatcctccacaatattccagtcgccgcctgcactgccgcatcctattttgtagggaaacgccactgtctcgtttttgtccctggcttccagaaaattccggatttcccccatggccttttccaatgcatcataatcggtatagaccatttttttcctgccgtaatcattctgcccgtacagatttccaatgaggaaccagcgtccgtccttttccaccggctgggcagatacccttcccagcagtctggacgtgtccccgtgttctttttcaatccactgctttgtaatcctcttataggttttctccacctcaggaaacagcttttttacctgtccagcgatgccatagccgaatgcgccctggcagttcacctgatggcacaggatgtctgcctttgaatcaaatatgctgccattgtaatactgaatcatatgttcctcctctgtccgttgttttccatcgtatttctctctccacatccacgatttccgcttctgtattttcctccaaaaaacgcacaatttcttccataatactgtccgcctgggcatatcctccctgtccatagcccgccggttcatgacatgtcccgcttttccgtcctgcccagcaggtagtccacggaacagccgaagtagtccgccagctttaccagcgaaaccgcattgggcacgctccttccgtttttccagtcgctgatatttcccatagatacatccagctccctggatacctggctggtgctgcccttgcgtctgatttccgcaaacagatttttcaagtcaatcctgtcctgtaccacattccatcccccaattccagtaaaaagttgtgtcgaatctatcataaatgctgagaggaaaattgtaaatgaaaatatgcacaaaagtccttcaataatttgtaagtatttcttcaaactccgtccatgaatatcatgtataataattacaatccgggtgctgcccggaatacaaaggaggatttattatggatacaaacaagaaaattttaataggagccattggcgctgctgttgtcatcggcggcgttgccatcggtctcctactcagcaaaacgccggaaaaggcggacctttccaccatacacacggaggctcccacggaagctcccacggaaacccttccccccgccacccaggctcctgagacagaggagtcccaggaaaaccaggaaggcgctgtttccagtgtttccgcatccattgagacctatacatccggaaaggtaaccatccagtatcctgtggtggaccagatggatgacgcctcaaaaaaggacaggattaatgaattattaaaagcaaacgccctgtcagtcataaaagccaatgacattgacgaggccagcgataccctggacatcaagtgcaaggtgatttccgcggaccgcaagcgtctcaccgccacttacaccggccttctgactgcaaaaggtgctgcccatccggtcaatatgttctattccaacacagtcaacctgctccaggtccagaacctgggactggatgattttaccgatgcctacaccatggccggctatgtgctcagcgacgacgtgaagttctcaggcatttcctctgatgtggaggccgaggtcctgagctaccgctcttccctggatttggattccctgacagctgtctttaacagcgcggatttccccctgtcctcagaatcccagtggcctgaatccttcagctatgaaaaacagggaaccatctacttttccctgcctgtgccccatgccctgggagactacgtactggtggcatttgacccagctacaaaatagtccctttgacgggatttgtcttgtgcgtatttaaagacaagccccggggttgatatcataagatatttgatatataattatcattaattctaatagataaaggagcagcaaaacttatggataacgtaatggtatttgaccaccctttgattcagcacaagatttccattctgcgcaataaagccacaggaaccaacgagttccgtgccctcattgaggagattgccatgctgatgggctatgaggccctccgtgatcttcctctggaggatgtggaggtggagactcccatcgagacatgcatgactcccatgattgccggccgcaagctggccgtggttccgattctcagggcgggacttggcatggtaaacggcatactggccctggttcccagtgcaaaggtaggtcatatcggtttatacagggacgaggtaacccatgaacctcacgaatattactgcaagcttcccaaccccattgaggagcgcaccatcattgtcacagacccaatgctggcaaccggcggctccggcgttgctgccgttgacttcatcaaggagcacggcggaaagaaaatcaagttcatggctatcatagctgctccggaaggccttaagcgtctccatgacgctcatcccgacgtgcagatttacgtgggacatctggaccgctgcctgaatgaaaacgcttatatctgtcccgggctgggagatgccggggaccgtatcttcggaacaaaataacaggtatcttcggaacaaaaataacaggtatcttcggaacaaaaataacagaaagccggacgctgcaatcacttcgtccggctttctgctatttaccgcttattgttattgtcggattttctgctgagtcttaggattccgtctcttccgcccggtctattttactaccttaagcccgccttttcccttctcaggcgcctcggtaacttccggctctgcttccacttccctggcctctttcacagcaatgttgccctggcccttataaatggaatcagacggaacacagccccttacgctggacagcgggtatacattggaattacgtccaatgacagttccgggattcagcacgctgttgcagccaatctcagcatggtcgcccaggatggcgccgaatttcttacgccctgtctccacatccccatcctcagcatggacctttacaagccccttgtcagccttcacattggaagtcactgcgcctgcgcccatatgagccttatatcccaggatggaatcgcccacatagttgaagtgggggacctgtgcctcgtcaaagatgatggaattcttgatttcacaggaattaccgatgacaacgtgctggccgaggataacgctgccccttaaaaaggctccgtttcgtatctgtacctttggcccgataatcataggaccgcccatggcagtggtgggagccatctgagctgtcttgtgaatccagatattctttccaatcttcttgtattcgttctccggaaggctggcgcccagactctcgatgaacccactgatgtcacccagaacttcccatggatactcatggccctcaaacagcttttcagcgattgtatggcttgtgtctaaaagttctttgattttcatctgttccagtttcataaattaattctccttttttgttttatagaatgcggctgccgcgtcaaaataacctctcatgttatattggttattcatgcggatgacattgactgtcctgccggcaacaaaacgattcagcttttccatatattcatctgatgttatggacccctccgcaacataggtaagtcccttctcccagctggctgtcagctccggattcagaagctgccggatagactggtccaccacgtcgtataccatctcacccaaaagggatggggtgatgacctgggttttcttgttcaggttcagatacttgatgttaaacagcttcttaagtatctctgccctggtagcactggtaccaatgccgctgccctttatctgggcccgcagctcctcgtcctctatgagctggcctgcattttccatggccagaatcatggaaccggaggtatagcgcttgggaggcgatgtctcgccctcctttatgttcagctccaccaaagtaagtatatcattttttttcaattctgcaagcatctggagcaatactgtcctgtcaacttttggagaaacagcgtttccggcgccttcctggccccggtttttatcctcgtctgctgtttttccttcctctgccccgtctttggcatcttcccgggactcatcaaaggattcctccaccccgttcttctttgccaggttcacatccgccaccttgagatagccgggctctgacaaaaccttgaaattggcaaagaaatgttccttctgccgttccagctccagactgtacttctggtatatggccggaggataaaatatgcttaaaaaccttctgcatataacctgaaataccttttcagaaagaggcgtcagcccccgcaggttccccagcccctgtccggtgggcacaatggcatagtggtccgttatctgcttgtcattgacataacgggtcttggcaatccccttatatgagcccaggttcagcacctcatccgcaaatgccgccatgggggcataattcttaaggccgccgatgttcttctgaatctccttggaaacagctgtggacagaaccctggcatcggttctggggtaagtgaccatcttcttctcatacagctcctggaccaccttaagcgtctcatccgggctgattttaaacatcttggaacagtcgttctgaagctccgccaggttgtagagaagaggcgggttctttgtttcctttttcttctccttggagagcacggtggctgtgagaggcggctccgccgtcaggaaagcggccagctcctctgcctgctgcctgtccttaaagccgttgtccttgtacagataaggggttccgaaatagcgggagccttccactgccttccactccgcctcaaagggaaccggctggccgtccctgcctgccgcctcaaaggaacccatgaccctgtaaaagggagttttcacaaaactgcgtatctcccgttccctgcgcaccaccattcccatgacacaggtcatgactctgcccacggacaggaccgtgaacctggttcccaggtaatttgacagggccgggccatatttaagggtcagcaccctggaaaagttgattcccataaggtagtcctcttttgcccttaagtaggcggaggcggacagattgtcatactctgtttcatccttggcctcacggattcccctgagtatctcttcctctgtctgggagtcaatccacacccgcttctgtttcttatcctttaccccggccatctgggccaccaggcggtatatgtactctccctcgcgccccgagtccgtgcagacatagatggtatcaatatcagcccggttcaaaagtcccttgacggtttcaaactgcttggatacattgtctatgacttcgtacttgaattcctttggaaggaatggcagtgtctgcaggctccagcgcttaaacttcatgtcataggcctccggataactcatggtcaccagatgtcccacgcaccatgtcacaactgcctggtcagactctatatacccgtcgccccgccttccccgtatcttaagtgcatcggcaaactgctgggccacgctgggcttttctgctatgtataatgattttgacatccaatccctcatttactttcttcacacgcgctccggtcccggttccttcaacggattttcccggcggcagagcgcgtattttaatagtataccattaaattccctttgtagcaatcaaaaaaaaccatgaggcgccggctatggcggaaccctcatggttttcctgcataaactactgtaacgacattccggaggtgacttccatgcctggaagctggcagtatcagccatatctcaccacatatgattcattcatcttttacaatgcaatcggggagcatcccgattacttctaccggcccatcgccgtggcaaaacaggtggtaaacggaaccaactaccggttcatgaccatagcggagcctgagcagccggacctgactccccattttgccattgtggaaatctatcagccccttaacggcaaggcctatgcgaccagcatcacgcctgtttagccaggaatttatacacggtcctggtcctgtactcgtcccctgccttcagtaagggggacggaaactggggcttgtggactgcgtccgggtaatactgggtttcaaaacagaatgcgtggcggcagccataatgtgctccgcccttccccggcatctcatcctgaaggaaattagctgtgtagaactggattccgggcagatccgtatagcattccagcacccggccgcttgccgggtccatggcctttgccgccagggccagctctccttcttccttatccagcacccagttgtggtcatacccttttccgaatacaagggcctcaaaatcagcgcctatatcccgtccaatggccttcatctcagtaaagtccatgggagtgcctgccacaggagcaatctctcccgttggaatggaaacctcgtctgccggcgtatagcaggatgcattgagccatacctcctgctccatcacctggccgctgtcatgccctgccaggttaaaatagctgtggttggtgaaattggcaaccgtatccttatcgcagaccatgtgataatccagtacaaggctgtcctcatccgtcagggtatagctcacggtaattctggcattgccaggatatccctggtcgccgtccgggctctccagataaaagtccagcctgctgccagcctctgtctcagaggaactgcagtcccagaccctgtcatggtacaggtccggtccgctgtggagattgttgggaccattgttggcctccagcttataatccctgccgtcaatggtgatgacagccccgccgattcggttggcattgcggccaatgggcgccccgaagtgggctggattcctgcggtagctgtccaaatcatcgtatcccagcaccacatccgccatggtgccctccttatcaggcaccaccatggaaacccatacgcctcccagggtgatgaatgatgcggataccccgttcttattggtcagtgtgtatctgtaaacttctgtaccgtcgggcattttcccgaatgaatttttctcaattgccatgattgtctgcactccttctccatgatgatacggaatccttccgcgtcctatttaggctggatatatcccctggcagtgagcagctctgcacagagtacggcgccgcctgcggctccccttaccgtgttgtgggacaggccgatgaatttatagtcgtatacagaatcctccctgagacggcccacagagatacccatgcctctctcaaagtccacgtctgccgttacctgcggacggttatcctcttcaaggtactggatgaaccgggacggggcgctgggaagcttaagctcctgcggaagccccttaaactctctgagcttctgaatcagctgctcctttgtcaccttattcctgaactttacaaatacggcagccgtgtggccgttaagcacaggcacccttacgcactggcaggtgatgaccgggctttccgccttgacaatgacgccgtcttttatggttccccagaggcgaaggggctcctgctcgctcttttcttcctcgccgccgatgtaagggatgatattcccctccatctccggccagtccttaaatgtctttcccgcgccggaaatagcctggtatgtagtggccaccacctcgtatggctcaaattccttccatgccgtcagtacaggggcatagctctggatggaacagttgggctttactgcgatgaatcccctctctgttccaagtctctttttctggaagggaatcacgtcaaaatgctccggattgatttccggcaccaccatgggaacgtccggcgtccagcggtgggcgctgttattggataccacaggcgtctctgtctttgcgtacgcctcctcaatggccttgatttcatcctttgtcatatccacggcgctgaacacgaaatcaacgcctcccgccaccttctccacctcatttacattcatcacaaccagctttttgacagcttccggcatgggggtggtcatcttccagcggtcacccactgcttcctcgtaggtcttgccggcagaacgggggctggcagccactgtcactacctcgtaccacggatggttctccaaaagggcgatgaaacgctgccctaccatacctgttgcgcctaatattccaaccttcagcttcttttccatcaatcattctcctcatcatcctgattttcccgcccaccggaactgccgcatttattcacagcaggggcgaatctttccctatcctataccaaacaacggaaaaaatcaagatttattcgctagaaaaatacatttgtacgcagcagaaagacatttccgtttttttgtatgcaacatccccactgcatcagggtaccagggacaatgccacctccatcatctgtgtaaagctggtctccctctcccgggcagaggtggcctcgccggtgaccatggagtcggatatggtcagcaccgccagggcattggcaccggccgccgctgcattggcatagagggccgctgcttccatctccacagccaggacacccatgtccgcccatgtcattcctccctgcgcctgcttcgcaggggcgtaaaacatatcggagctgagtacattgcccacatggtatgtcagtcccatctcccttgccactgacacggcccgctccagcagacggtagctgcacaccggggaataatcccccggcaggccaaaaagacggacaaaattgctggtggtgcaggctcccatggcaaacaccatgtcccgcacatggacatccggcatcagggcgcctgccgtgcccacccgtatcaggttcttacagccgtaaaaatgaatcagctcataagaatagatgccgatggaaggacaccccattcccgtgcccatgacagataccggcctgccttcataggttcccgtgtagccaagcatattcctggtgccgttaaactgtttcacgccctccaggaaatgctctgcaatgtactttgcccgcaaggggtctcccggaagcaggatagtcccggcgatttccccctggcctgccccgatatggggcgtgggtatgttggatgctgacatggattatacctccttttctgttacagacgcactttgctgcctttcccgtctctcttagccagtttcagacggtttaaatggacttccttgcctttgtaatccacaatgggattctcaccaatcagatacagcttctccagctcctcgttcttggacagccggattccccggacgcccctggacgcttttttcagcacggatatctcctccagggcaaaccgcaggaacacgcctcccgttgtctgaatcaccacctcggtctggccctccaccggtatgacggccgccagttcatccccatcctggagcttggtggctgccaccacccggttattggtttcaaattcttctgccggcacctgtttgaccatggccatcctggtggcgaatataaatgtcctgcccttcatgtccccggcgctggtcagataaacaatggtatccttggtgccgtcgaatttgctcaggttttcgatgggagttcccttgtccctgagcttgccggccggcacgtccatggccttaatctggtacaggctgccgctggctgcaaagagacagattttgtccgtattcaggcatctcaccacatggacctgttcattgtccacggtttcctggttccgctcataggtggatttgtccagcagcttgcagtatccgaagcggtccatcacaaagaccatctcctgaacagccacagcgctctcatcgtacactgcctcaggtccgtcctctatcagtgtgcgcctgggagctgcgaattcagccttgatggcagccaggtcctcctttatgacacggtccatctcagccctgcttcccaggattttcttatactcggcaatcttctttaatgtttccttgtgctccttttccagggccaggatttccagtccgattaacttataaagacgcatttccaggatagcggaggcctggcgttccgtaaaggccagcttctttgcgtcctcctcaaagccgggaaccctgaatctgatgttggtcacatcgccggtggtaaggcatgccttggcatccttcaggttcttggaccccctcaggatggctataatcaggtctatgcagtcgcaggctgtaatgagaccttcctggacttcctttttgtccatttccttctggagcaggacattgtatttgcgctccgtgttctcatactggaagttgaggaaatttctcagaatgcccttcaggttcagggtttccgggcggccgtccgcaatggccagcatgttgacgccaaaggtatcctccagctttgtcttcttatagaggatgttctttatcttgtcaatgtccgcgtccttgcgcagctccagcacaatacggataccttccttgttggactggttggagatatccaccacatccgtaagcttcttgctctccaccaggtcagccacatccaccaggaatttattgattccggcgccaatcatggtatagggaatctccgaaatgaccagtttatccttgtctgccttgcgcttgccaagctccacctcgaacttgcccctgagcttgattttccccatgcctgtctcatatatctgcggcagctcgctcttgttggcaatgacgccgcccgtgggaaaatccggtcccggcatcagctccatcagctcctgtgtcgtcacctcggggtcatcaatgtatgcctggaccgcgtccaccacctcccccaggttgtggggaggaatacttgtgctcatacccacggcaatgccctcggccccgttaatcagcaggttgggaaccctgaccggaagcacctccggttccttttccgtctcatcgtagtttggcacgaaattcacggttttgtccaggtcttttaagtagacctcctctgcaaacttctcaagccgggcctccgtgtaacgcatggcagccgccccgtccccttctatggagccgaagttgccgtgtccgtccaccagggccatgccctttttgaaattctggctcataaccaccagtgtctcgtaaatggagctgtcgccgtggggatggtacttacccatggtatcgcccacgatacgcgccgatttcctgtggggcttatcgtggtccagacggagctccctcatatcatagaggacccggcgctgcaccggtttcaggccgtcccttgcatcggggatggcccttgcagtgatgacgctcatggaatagttcatgtagcttctctgcatttcctcactgtattcagtccgtaatatcttttcagccatgttctaattgtctcctgtctatgcgtcaatctccgcttcatccgcatgttcataaatgaactggcggcgcggtcccacctcggtgcccataagcatctcggttatctccgtagccattctggcatcctctatctccacgcgcttcaggacccggcgctccgggtccagggtggtctcccacagctgttctgcgtccatttcacccagacctttgtagcgctgcagtgtaaagtcgcctgtatgcgtcttgcggtagcgttccagctccttttcatcgtacagatactgctcctccccccgcttgggtatcaccttgaacaggggcggcatggcaatatacacatggccgtcgtaaatcagctccggcatgaaacggtagaggaaggtgagaagcagggtgtcaatgtggctgccgtccacatcggcatcggtcatcaggatgattttgtcatagcgcagctttgtgatgtcaaagtcattgccgtagccttctgaaaaaccgcagccaaaggtatttatcatggtcttgatttccgcgttggcaagaaccttatccatggacgccttctcaacgttgaggatttttcccctgatgggcaggatggcctggtactggcggtttctggcagtcttggcggagccgccggcggaatctccctccacaatgaatatctcgcacctggatgcgtcccggctctcgcagtttgccagcttgccgttgctgtcaaaggaaaatctggatttggtcagcatgttggtcttggccttttcctcggcccggcgaatcttggccgatttttccgcacagccgataaccccctttagcacctccacattgcggtcaaagtaaagctgcagctcatcccctgtcacggtgaacacggccttggtggcgtcggcgctggccagctttgtcttggtctgcccctcaaaaatggggtcaggatgctttacagcgatgacggccgtcatgccgtttctggtatcagctcccgtaaaattggtatccttatccttcagaatgcccagctccctggcatagctgttaatcagggccgtaaatttagtcttgaagccggccagatgggtgccgccctcctgggtaaagatgttgttgcagaagcccagtatgttctcctcaaaggtatccacaaactggatggcggcctccacctccaccttgtccacggttcccttgaagtaaatcgggtcatggacaggcgccttgccggagttcagctcccgcacataggcaacgatgccctccggttcatggaaggtcaccttttccccctctccgggccgtttgttctcatagtaaagggtcaggctggggtttaagtatgcggtttcatgaagacggctcttaagccagtccgccttgaaacgtgttttctcaaatatatcgccgtcaggcaggaaattgatacaggtaccagtctcccttgtctttccaatcacagggaggagcccgttttccagcttaatgaccggccttcccttctcatacacatcgtgatagatgcagccgtccctgtaaaccttaaggtccatatgggctgaaagagcattaactacggaggaacccacaccgtgaagtcctccgctggtcttataagcgtcgttatcgaatttaccgcctgcatgaagggtggacagtacgattcttgcagcggatatgcccttcttgtgaagtcccaccggaatgccgcggccgttatcacggaccgtacaggaaccgtcggcttccaatgtcacccatacgctgctgcagaatccggccaggtgctcatccaccgcattgtctatgatttcataaatcagatggtttaaccccttggagcccacgcctcctatatacataccaggacgcttacggaccgcctccagcccttccagcaccgtaatactgtccgcattatattgttcctttgccattctattcctccatattgctatgtacagatgcgtacatatgtttcgtcttatagtattaaaccatatttaaattgttttggcaagttccggccgtgagaaattcccgcatacaccccgcggcgccttctgtatcccggacttacagaccggaataccctgtcccgggacaacaaaaaagccctgcacacttgcaaggccttaaaagcagatgacgggaatcgaacccgcctccccagcttgggaagctggtgttctaccgatgaactacatctgcacaacactgatattataccatgtattttggaaaattcaagtgtattttcttatttttgtaaaattttctgcattattttctacaaatccggttcaggccccaggccggaataaaaacaggccgtccggtccgccgggaccgggcagcctgtctgctgcctaaagcaccttatccagaaagctcctggtccgttcctccctgggatttccgaacacttcctcgggagtgccttcctccacaatgtagccgtcatccataaacaccacgcggtctgccacttctctggcaaatcccatctcatgggtgaccaccaccatggtcattccgtcggccgccagctgcttcatgacctccagcacctcccctaccatctcagggtccagggcggatgtgggctcgtcaaagagcataatatcaggattcatggcaagggagcgcgctatggccactctctgcttctgtccgccggagagctgtcccggataggcctccgccttatccgccagacccaccctggccagcagttcaagggcctttttaccggcctcctcttttcccatgattttaagctccgtgggagccagcgtaatattctccctcaccgtaaggtgcgggaacaggttaaaatgctggaacaccattccgatgttttcccgcaccttgttgatattggtgttagggtcggacatgggatggccgtccaccaccacatggccggatgtaatcttctccaggcggttcagacaccgcagaaaggtgctcttgccggagccggaggggcctatcatgcacaccacttccccctctcttatctcaatgctgatatccttaaggacttccagctttccaaagttctttttcaggttatggactgaaatcttattttccataggacactctcctctccacatacttggcaattctggacagaatggtgcagactaccagataaaacagggccacgcaaatccagatgggcatgaccatggaagcggaattggccgcaatgattttaccgttctgggtcagctccctggggccgatgacagacacaagggatgtgtccttcagggaaataatgaactggttgataatggagggcagcatggtccggaaagcctggggcaggattaccttgcgcatggccttgccgtaagaaagccccaggcttctggctgcttccatctgtcccttgtcaacagcctctatgcctccgcggataatttccgccatatacgctcccgcgttaaggctcagggccacacagccggctgtaaatgcgccgcctatattgctccactggaaaccatagggcttcaggacgcttcccacgccgtacatcataatcatgacctgtaccagcaggggcgttccccggatgatatcaatatagacatcggcgatgagttttaatatcttaaagtcagagaccttgaacaggccgaaaataacacccagcaccgttgcgcagagcagcgatatcacggtcatctgcagggtgattcccagggccttaaaaaatgatgggtaatactgtgttatgatgtttactatctgcatactatcatccttttctgattattcgttgacgtgcgtcattccagggaggtgctttgcacccatggaatgttatagccaaatttaaagcacttaagcaaagcctgacatggccttcgtgtaattgctttaaattcatccataacccgccggcattgaaaagacggcattcataaggcggtgttgaaacacccgccttaaaaataccggcattgaggcgccggccctgcaacccgcaggagccggcgtctggcagcactgcctgacggcttttgcccggcagtctttattttgcaatatatgtatccaatatctcgtcgtacctgccgcttgccttgatgttctccagtcccttgttgaacatctccaccagctccggattagcgccctttaaggttgcgaaaccataggaggaacccttttccattggtgtgggaagggtaagtcccagtcccctggatatctcataaccgataaccggataatcctcaaagcaggcagctgcctctccggccagtacggcctgatacatatcggatgagctctcgtactgtattacctcaaaaccatactggtccgcaatggactctgcaaaggtgcagccctctgtaccaatcttggcagccaccttacggtcctttaactggtcgtaggaggtaatatcggaatcagacaggacagccatgccaacgccggaatcatagtagggttctgaaaaatcatatttctgtaccctctcatctgtgatggacatgccggcaatcacgccgtcgcactcgccggcctccagcgcggtcactgctgcggagaatcccaccggaaccacctcatattcaaatccctggtcctgggcaattgcctgtaagatatccaggtcaacacctaccatctcgcccttctcattctcaaactcaaagggggcaaaggtggtatctgtattgatgatatacttcttgcccggggcggctgcgctggtttcaccggccgcttccgtgtctgctgccgtggtatctgcttctgctgcagtctctgccgccgtggtgcctgctgctgttgtctctgccggcttggagccgcatcccgacacagtgaacgccatgatggcggccatggataacgccataaatttcttcataattacttcctcctctattgatttaaataaaataagggcgactttaatacatcatgtctcccttgacctgtgatgcacctgcatcatcctgattactatatcacaaagatttgtcaaagtcaacttattgtgacggccacaatctaaaaattgtgcctatccttttatctcacaggaaagcgttccacaatcgcgcctgtgtggtaggcttccaaaagcatttccaggtctttaatctttgtcctgagctgtttgcccacatccgtatcccccaccagcttccggctggacacacgttttacaatggtactctctgagtgtatgtcactctccttctcaattgcagcctccgtggactcaaagggctcatgggcagccagaatcaggccgtaagaattataaatcagcgtatatcctgcgattcctgtctccttctggtatgccctggaaaaaccgccgtcaataaccagcacctttccgccgcattttacaggattctccccatttttggacttgaccggcacatggccgttgacaatatgtccttcctggggtgacaggccgaattcctccaggatgcggcccactgtattctcatcctccagcatacagtaatatggatttttctcctccctgtgggtctccttgtccgccaggaaatagcgctcaaaggtggccatcttatccttgccgaacaagggggagtcctgatgaagccagatataccagcatatatccctgccctttgcccgctccaccgggtccactgccataaacgccttcctcacataactgtccagacactcatagaggggctttcctttatatttccggccgtatatgtccacctctttaaagctgccgtccttgtttaaggggatgcagccgtgatacaggagattgccgttatatactttgtaaaggctgccctttgccagcaggaaacgcatatgctgctgaagcttttcacagttctggaacgcggctgccaggcgttccatgatggctccctcctcaggcgtaagcctgtaagggtctgccgggtcaatggtgggaaaatggcagtcaagcatctcatggtcgccgctttccagccggactgtccccttgccgaaatcaatgcggtggagcatgctacggtcatccaggcagaattccgggtgctcctttataatctgcccctccaccttgaactggatgacagatatagctttatgcatcctgatattcagttccgtctcactgggactgctggcatttgcccctttaagctggaaacaggcacaggggtcatttccgtaggtatccagggcaaaggttgccagcggcagcaggttgatgccgtatccgtcctccaggatatccaggttgccgtatctggcgcagatgcggattgcattggcaatgcaccccttctggcccgcagcagcccccatccacagcacgtcgtggtttccccactggatatccagggaatggtaggtcatcagcttgtccataatcatgtggggccccggccccctgtcatatatatcccccagaatatgtaaatggtccacaataaggcgctgaatcagttcacagagagccacaatgaactctcctgccctgcccacccggataatggtctgtataatggcattgtaataggactccttatcccttacatccactttttccgtaatcagctcctcaatcacgtaggcaaattcctggggaagggccttgcgcaccttggacctggtgtatttgctggcagcgcgcttgctcacctcaataaggcggtacagggtaatcttgtaccagtcctcccggttcctggcatgttcaagtatctgggccatcttctccctgggataataaatcagggtggccagggtctgcttgtcctggctgctcagggtgtttccgaacacatcgtttaccttgcgccgtacagctcccgaaccgtttcgcagcacatgggaaaacgcctcgtactcaccgtggatatccgtgaggaaatgttccgtcccctttggcaggtttaagattgcctccagattaatcacctctgtggaagcggccgctatggttggatacaattcagcaagccgttccagataccttgtctgcaaatcactcattgctttcctccctcaatacttatatgatgtttttactcctccctctcccggtcaacataatgcctgtcttcttcgtcaatataatccaggctcaggtaatcctctgtcctggctgataaatccttctttttcagcgcgctgctcacataggtggctgtaagcctgtaaatgacggcaaacagcggcaccgcaataatcattcccacaaatccgaacaagccgccgaacagcaggatggaaaacaatacccagaagctgggaagtcccgtggaatcccccaggattttcggccccaggatattgccgtcaaactgctggagcaccaggatgaaaataaggaaatacagacatttcatggggctcaccagcaatatgagaaaagcgctgggcacggctccgataaaggggccgaaaaacggaatcacattggtcacgcctataatcacactgaccagcagcacatagggcatttttaaaaactgcatggcaaaaaagcacatgattcctataatcagggaatccaacagctttccggttataaaacctccgaatacagtgtgggcaaaacgcacctcgcttaccagccggttggcgtccttaagcttcagcaggctgtagacaatcttcttgctctgggccgacagggtgtccttgatgttgaggaaataaaccatgacaatgacgccaatcagtatgttcttcacaactgtgaccacgcttaaaatgccggtggagagctcgcctatgattttagacatattgggcaccaggtctgtggtcagccagttctggaactccgtggcggcctgctcataaaaaggcatgatggtctgttcaatggtggggttatcctcaaacatcttcatgagccagagactcaggttattgatgttctctcccaggctttcctgaaggccgataatactggtgtaaatctggggaatgaccatccagaacaatccgcagacaatggcaacgagcagaagcaggcttaccagcgtaccggcggccttagccagaccgtctgccgtgcgtgcgtccttaatacagcgtttcagttttcctgctgtataggccctggtcttgttatagataggcagcatcagataggccagcactgccccgtagataatgggcatcaatatggatacgatttttcccgctgcccttgatacaatttcaaaacgcgacaggaaaaatccaaatgcaacgctgcaggcaaccacggccagcgccgttgttccccagtatatataatttttaaatcttgggtttttcatacatctttactcctatgtctaaagtattccgtcatttcggcaagtcattcacccatatatcatatcataagctgaaactaacagcaattaggatttaaattactgcgcctgttccccagggatttttacggaatcttaacggggaggacaaagcgggatttttgtggtatgatattcctatctttgaaaaagaggtgttgagacatgtcttatatcataaaaatggccctggacatcaaggcccggtttgagcctcccgctcccatgacgtccccgctggaagcctactgcgccatcgggaccattgccaaggcaatgaagcttccgatgccggagaaaaaggatacgctctttgagatgcgtgaccagctggatgcggatatgggcggcaatgaaccggaggacagccggacagccaggattcattccatcctcaagggctttatacgaaatgaggaaaccacggaccagatgatggagtacgtgaaatacggctatgaaaatgagaggtgaggaaatggcggattttttggcgcctgtgcccgccggggtaatggcgctgatggaacggccggaacagtggtattgctgcatcaggccgaaaaacagagcagaatgtcagaaaggggaatgccgttgtcatagcattcccctttgattttatggtgtggttatacggcctttggctctgccggcttccgcaaaaccatgattttaacccttctcacatccccaatatggaatccgtatcaggacggatgatattccaggcggaaaccagggcctctttcagcttttcttcccctgcaaactccttttgcctctttaaagcatatgcggttttttcttccggcggcagtatgtagtactcactgtcatcccggtatgtatcgcttaaaaagatatagtttctcgaaggcggcctccggtaggcaatatcggctatggaccactgtacatgatatccctcgctgtacacctcattgtaatccacaaaaataatgatgtcttccttcttgtcggtctggtactttaatgcctctattctcataaattccatccttccttgcagccgctggcccctgttcatccattgcccgtgcagatgtattaattagaatttaccatatcacccggtatttttcaatacaatttacatggttgggcttaaagttacagaaaacaaaaaaagcccttgatttcacaagggtttcacagagccactggccggactcgaaccggcgacccacgcattacgaattttaaaaatcggtattttcaacacattttattagattgtgtcattcaaaaaagtacgtatttaagccatttctaggcaatatcctattttccaccaatttttcttgatgcaactttgttagtcaaatgttagtcaataaaatgccccagtatgccacatataaatgacatcctgggactttgattagttctctttttcttctatttgccgtacttttcggcctgttcttttggcaagagggataatctctttaactgtcacccgctgcggaccataaaatgtttccactaccaccctatcccccggagctatcttatctatcaatttcaaggggatttcccactggtattgcttgccaccttcattgaataccgctttaatcccctgtctccttattcgtcttactggcaccatatccttaccttgttcacacataagtagatatgtggtgtatccatccatcaataccccgtgttcatcaatcacaatttcccttttatatacaccgtacttttcatagaactgcctagcctgttccatcttcttttttgtcggccttgtaccagaatttcttctggaaatagatatactggataacctgacagtatgtttatcattagccgcacccgcctggaacgcatcatttccccattcagacagcagttcatagaatcgctggtttacttcttcattcactaaaagcttaccatataccctctgatgtgcttcccttacgatttcgggcgtgaaaacaaaatcttcggttgaatattccatacccatcttataaatattgtttaacacccttgccatctgccctaaaagcgtctttgacaattcatttattccggcagttttggccatctccataagcatttctatattaattggatagtgcatctactttgccctccttgcccgttcagtccttttacccatgataacgccgtactggaatatattaaaaaactgctgctcctgcatcaagtgattatatgtacgccagtccatcaagtgatattccttcccaggcttctgatgggaaagcatctccatattgtctttaaagtccatcatcgcccttgccttcagcagcacacgacaaactggctcccatgtgtttccttcaaggttgcccttttcaacatcttccaatgtttctgcatctgcatccaaaaagccccggcataacataacaatgctattaaaatccttgcaattctcatttataacaactgcgttctgtgtcacggaataaaataccactacctctgatagcgaatgcttaccgccccatgactgtaatatacaatacgaatcctccagtgtaatttctgccacgttgcaagcgtataatcttcttttttcatcaattaaatgatacattttcaatttacctctttctttttattaggggccatgctaatatacctatgtgattaggaacggccccggctgtttcgttggcccctgtcagtgttggtagcactggcagaggctttttcttatgctattgcaatctcatgtacctgtgagcgtccaaagaatcgggccttataagctttcccatctccccggcttccccatatcagttcagtaccaaacagggccttgcttccatgaataacttcatatcctaactgtttccagccgttccaggtatttgtttcttcctcaactcctgccgtggcctttgcttcttcaattctctttgcgttgattgcctctgcctttgcagataaccatgccctgtgtaaacactctgcaaaagaaagttcttttttctcccggtaaagcctccatgctctcagcatgattttttgaagattgtacttcatgatttctgtctccttccttgtccggctgaatcatcttcctggctattggttttgctctattgctcactcacaggtatatggttttcagcttcacaacttttcgggctgttcgtttgtttcatccttataactacattatatatctattcacgtgaatagtctattggcatcatttatatatttacgtgaatatatttgtgaattttgtatatttacgtgaatagacttttttgctataatattggtatggtagagaaggtgtatttattattcgtcactccatttacctaaaaatgaaagaaggtgataaaatgccagaagatagcaaaatcagcaaagcgcagcaaaaggcggtgcatgaatatgtgaaacgaaattatgaccgcatcgaattaaccgtaaaacccaaagggaaaaaagaagaaataaaagctcatgctgaattaagcggagaaacattaaattcctttattaatcgtgcaatagacgaaacaatgaatcgtgacacgatgcagacgcagaaggaaatctaattatggaatacggattaaacaaaacccaatacttgcacaaaatatacggctccggtcactatataaagaaataatccctttacttaaatatgacatatatccaaaggcccattcactactttcgtaatttatgcgaatgggtttttggatatatagaaaagaacactaatcttgttttaaaatcagtgttctcaataatttaacctatcttaatattttttttcatcagctttattttgattatttctctatttctcccaacttgacaggaatcgttttattaatcggaaggattttccccaaaatcgggaagcgctgtccatcttctaactctgcataccccaatatttcaaatcttaatggcctgctactgccttttggcatcagtccaaacatttccgcagcagttggacactgaatgtcaatgtagtccattgcactcatatcataatctccttttcataataaatggttgattctcaccgggattgaatccgcagcccctatcagtcttgcgtgtctattgctttcggctcacaggtacgattgataggtttgtgggggattgtctgccccggctgcttttgttttgtgttccttgctatgtatatagtatatatctatttgcgcaaatagtccattggcatacttcatatatttgcgcaaatatatttgtgaaatttgtatatttacgcaagtagatattagtgctacaatatgggtataatgaaaataggtgattttaacttttatcacctaatgaaaggggaaatatgaatctatggcagaggaaagcaaaataagcaaagcccagcaaaaagcagtaaataaatatatcagtaacaattatgacagaattaatctcactgtacctaaagggaagaaaactgacatatcgaaacacgctgaaatacatggtgaaagcctaaatggttttatcaatcgcgccattacacaaactatcgaatctgataacgccgcccaggaaggagtgtgaccctatgccattaccacaagaaagaatccataccattgacgatatttacaatctgccagaaggtgaacgggctgaactaattaacggacagatttattacatggccccacccagcacagcccatcaaagaacattgtcattcctgcacctggagataggaaaccacatccgcaacaataatggttcctgcgaggtattcccggctccgtttgccgtgttcctccaggcagaggatgaaaagagtaatacaaactacctggagccagatatatccgttatttgcgacaaagacaaattgaacagtaagggctgcaacggtgcgccagattggattattgagattgtatcccccagtagcaagcctatggactattacaccaagttatccttataccgtgaagctggtgtccgtgaatattggattgtagacccattacggcagataatccttgtgtatgatatggagcatggggacagcccggttatccattcctttaatgattcaatccccgtaaggatttatccaggattctctattgattttagccaattaaaactttgatatcattgcagaaaggagcgtaaaaccatgagtaatagagacttagccaaaagcttaattgaccagattcccgaaggtaagcttgtttttataatcccatatctccaaggagctgctatcccggatgaaatacccaatgctgaaacattggaagcatttgcagagctagagaacgggggaggccatctttttaccggaagcaccgaggaccttataaacgaactgatggaggactgaccatgttagatgtgcggtattctaccagattcaagaaagatttcaaaacttgtgtgaaacgcggccttgatgtatccatatttcagaatgcagttgacacattaagaatcccggccccattgccagaaaagaataaggaccataatttatcaggaaactatgtcggttacagagaatgccatttgcagcccgattggttattgatttaccagcaaaccgaaacagaattgctgttgcagcgaaccggaacccatgcggatttatttggaatgtaacttaaacgaatgcagcagagtgtactgtaaaacgccgtacacccatagggtgtcgcgaaacacgacacctaaagaaacatgagcaccagcgtaaaccaaaacataaccagcggattgggggctccccaaaattgggcagaccttttcatagaatctaactatattcaagaacaaagtaaacatatagttcataatgtaaaggatattttaaatgagaaaaaataataaaatggagcaaccaataactttcttccaggtatggggaaaactccccttaccaccgtagcaataggtacgctggtagggtataccagtgggaagcagcaaggaggtaacaatcttgtcctgccctctgccccgaaatagggcagtggttatctcacagccggaaattcggctgtgagatatgctttgctgtgtcaacagaaacaatatagtcttgaagctctctaatctgcacaccgccgttgttttgaacctccggaggtgtaagtacgctggtcatttcatcacttccaaagtaaatcatataaatctgttgcttcctaccgccttttgagtttttgtcatttttgacgataacctctaaaatagtccattttattgaaaaaaccgtacttacacatccttgaaaaccactttacgaattcagttctaatctccaatccctcatgcaaatctgctttgccatgtctacagtgatttcatagtctattgatggtcttccgccgatttctgaggttttactcttttttgagtaaccaatatgtaatccgcattttctcaaactctacagcgtttccatttttggaatcgctccacataaccgtataatcgttttcagtaaaaccatactcacacatacggtcaaaccatgtcgtgaagttgctcttaatttccagtccatcatgtaactctcttgcttgcctcctatactttcttccatttttggaaaaatgtctttttggcggcggaattttccgccgtgaaatccatcaggtatgcccggaaatagggtatacctggacataggcagagctgcattgtcctaactcattccagtattgtccagacctaacaaatcgcttcccacctactctatcccccttgactcacactcatctaaggcaggactgtttcactgcccaatcggattgtcataaaattgtacctcatttttgacccggacttttttttgtatgcattttagtgcattttgtgcattcgtcaacgtatatgtgcctatagttgataccggcagagggatagcgtttagtttagtctattttgttttttttgtgcgcacttttgcgcagtttcaaactatgatatcataaagcattatctgattgtcctggggtagaaaaatactgacccggtatttcaccgccccaggccagtattcattatcttaatcagcttcgcatagccgcattccgataatatgcagatgtgctctgcctgggtgatggactctttgcgtaccccagcgacaagagcatttccaacgtgcctgtctcaccgacacgttacgataagttggtgatatcactgtttttcttgctctaatgctttaagaataagattagccgaataaaatatagcattcgcctcctttgccgttatttctccattgaccacccaattattgacgtggaccagtgagcgccgtacctctgccggggtatcccaattcaaatagtaaattgtcatggctctcgcccatgacaattttatcgtgcgtctgatgcacaacctttaaatctcacttcatttcttacgattaattttctttctgctataaacataaaactaaggttttctaaggttttattgaacgacaaccatttggtggtcgatgaaccgtatacatgatgtttatggttttagggttatttaggggtatattgtaaaaatgtctggtttaatctggttcctatactgtgcaagcgtaagtttccgtaagcagatattagccgtccataccccatagaaagcatcagaatgcccttcctgctattttaactagctatgcgggaatttctctgtatcctcctgtccctcggtattataggcgctttcccttccagcagcagactaaacaatgctaatgttttcctgcggtatgcgtaaaaatcatcacgtttagcgggaatatacgatttaatataaatacggtcataccctcttttttgtgtgagagattcaataataaaagtagatagtcctggattacttaattcagccgccttgcatattaagcctttgttttcttccagtctggcaagttccattaattcagccgtccggctgcaatctattccgtaatcgcttaagctcttgtcccttgtcctcattgcttatacaccatccttctgatataattaaagcaatgtgactttcccgctgccatcacccatttaaaaacgacagcgggatttttatatacttccttccgtaaccattcttacacccacacgattcttttcgttgtttccgaatttgactacaagctgaccaaatcttgtaccatcaagtattagctccgctttagcaatctggtttccaccagatatattgctttctgccaacgcttccttaagagcttgcttcatagttgataaaggggataccacttccggttcctttgggttatctcccaagatagcagcaaacatcccggcccgtggtggcactactgtaccagttgcaagcattggcattctaaatggtactgctgcataggcagaggctggataactggttttgcttgataggttcaaattagggatggcagggattgcaattcccaccttatccattaccctattgattgcttcgataattttgtttatcccggatatcaccgaatttaccatgccctcgatacctgaaacaatcttcgctatcgtattctttattaccgtcacaatactgttccatatttcggtagtcttattcattacagaatcccacactgattctatggcccgtccgattccttcaaatatgttctgtgcatctccttttaaagcattccataatcccttaacggtactggaaatacgcttccatgcttcctctaccgcccctaaaaggccgcttagcgccgtttttatgattgcgccaatactttctagtcctccactaataaaatcgcctagtgacgttatcagaccttccacaaggcccattatggcatcaataacacccccgaatatttccttgataccttcccaagctttttcccaatctccagaaaatacacctgtcaggaaatctatgattccagaaaaggccgttatcagcccatccaaaacagatgccgccgtgtcaatcaggttaagcaggtacgtgcctattgtctccagtataggggcaacaacgggcagtatgttggaagatatccaactaagtaaaggctttaaatattcatcccatattaccttgattaaatctgcaactttccctatcagctcaatgattttattgataagcggctgtatcgtaccttcatatacttctgagaatttatctgccagtttttgaagggttggggcaatgtacttgttataaccatccagcagattccccaggatttcagacagcccattcttaatagattcaaacagcggagcaatatgctcgtcatacatcttgtttaaattctcgaatgtctcagttatgccctgtgaaatagaatcaaggacggtttttattggctccatcgtatttgtaagagcttcttttatcttatctttgttctctacaaatggggtaagaatcgtgtccaacacatccctgaacaactttgccgataattcagtaattcccatgaatatatctgcatagattgctataatatcagccgtgatttgctttgctgtatcgcttctgaatactgaaaaaatatccgctaccgccaccgcaaaatcagcgcctatggtactgatttctgatgtgatatcaaacatacttatcagataacccttgattctgtcttttgcactttcaagatataatgctattccccctgtcagattatcagctattgtcagtccaacactggaaaacgccccggcagttcttcccaggttgtaggaaatagtatccaacatggtattaaaggccgacataacgccctggtccgtaaaaatatctttcagactatcgccaatacttgctatgtttgtctttattgaatccaggacaggcttgtaatcccccaggccttgccagaaccccgattgaaagattccccctatctcaatcagtctttgtttgattgcctccagggtttccatgacattatttaaaaacggtgattctgtctgctgttcatcaggggacagtcccggcggcattatattgctatctcctgtattttcagaaccttcctctgcatcacgctgaatctgtatcaggttatcaaagggtgctaatgatttctttacctgtttgcccgcgtcctttactccatctgcaaagtcctccgcaccatcagccgcgccctcatatccagcctgtacctctgccatttcgccagccgcttgtgcaactccgctatttacagacttcttacccattaccgtttccgtgaaattcttaaatgccgtggttgctgttgacaaccgttcaaggaatacatttatggcctttataataggcgtaaacaggtttataagcccttgtccaatcgtagcctttaaagactgtagccttaactgaaaaatccttacctggttggcccatgaatccgatgtgcgggcaaaatcaccgcttgccgctgaaagctggttctgtacaaattgcaagcgtaaggcaaccttttcctgctccgtcattttattagtggtttttccgaaaccatttgcaagagcatattggtctaatgcactttgcgtcatgacaacgcctaattccttaagcgattccgtctcgcccgtgaacacagattttaattttgtatatgcttcttcctgcgacaagttatagaaacttgcgacatcacctgttaacccggttaatgccgtagccatatcataggccgcgctttctgaataaccaaaagatttagacattgctccaaacgtaccgacatattttttcgccatcgtctcagaaagcccaaaggaatcagccgccgcctttgcgaaatcatccacctgttttgtcatgctgggaaaagtcacatctacaacgttttgtacctctgccaaatcggaccccagttccaaacattctttaccgaactgcacaatctgctttatcgcaaaagcggtaataatggccttaccgatgcctttcactatgccacccagctttgtcatggagcctttaatttctgatataccacgctgcatcccatctgaattgatttttgtatcaataacaatatttccatctgctttcaatatcccagttcctcacttcctaagagacagaaaaagccggaaatcttgcatatatcgcaaaattcccggctccatttagcctttaacagataccactctatctattagtttgatatgtaattttcttttctacctccaggataatcacatcattttttcgcttttttatttctgccgtatttcccctggacaaaatcttttttattgcttcaatcattttttcatcagaactcatataacacctactttacagggaatgggtacttgctcccgttgtctgctgcctgtttgtactggcctgtatactttcctgcttgggattccatttcttttgttgcaacctccagcttgtcgcgaaccgcttccaaagctgcctctaagaatatctcaaacagaaagcggttatctggaccaacaatggaaaggggagactgtctcccaaaagcagcctgtcttacatcggcattaaatatataatccatcttgtcgttgataagctggttaaactccccaagtctggaagtactttcctccagggatattcctgcctgttctgcaggacttccgtctgccttaactttgatacttgaaagtcgttccgattcgttttttaagtcccgcatagcttcatcaaatcggattaggatgtttccatcctttggatttatctttataacccggttggaatccccattgattgtaaatgtttcaaatccatcatcaaaattaatatttgccattcctataacctccgcttatcattttctttaatcttgctttatcctctgttaccgcattctgcataaatccagatatgtcctccatacccttttccatgcatcctgccgcaacccccggcaaatcattttgcgtttctcccagaaccttcatgcagccgctcaaacacgtttcaaccatttctattttattcattgtttttaccctccatcttttcataaatcgccgccagttcacaaataaccacaaaaatcattattccaataacaatcacattatcccccactttctttgtgttatagtaaaaaataaagcccttccttaaacggctctgcgtctcagcgtctggctctatacaatcatactgctatgtaatttttattctgctggcatataaaagaccctctgcccggtctgatatgctaaatccacctcataaagaacacctttagccctcgccatatcctcatagactcctacaaacaatgctccattatgaaacctgcttctgacatacaccgttgcccctttaccatcgtggctatattctgtatatatttcaccatattcaaggtattgccttgcatcctgggttcttatcttcaccgcttacccctcctttcgatttctgtcaacaccgccattgctatatccttgctgaatgaatctggatgttttgtcatgaaacacttaactgcatttacggtttcctcccagtattcatcatcatctggttttcctactggaagccgctgcttaaatagcttccaaacgtctgcgaacatttcaaattcttgtttcacatctgaattttttaccacatcggccccctgttaatcaaatggtgttttctcctttacgggcttgaaattaaaatctttactctctgcttccttgaaactcatttcctcaccaacaaattccatttgaaattttgctgtttttccttgtcggtttttctctaccttcacccctttgtatctttcattttcttctgaaagattccaaagtagcataacaactgatgcatcctgctcaatatcacctgattccctcagttccgacatagtgggttcttttgtctgccgtccctctgatgccctgtttaactgcgataagactatgataggccggttcaactccattgctaatgatttaattgcctttgaaatatcgcccacttctgacacccggttagcataatgacgttctgtctttataagctgcaaataatcaatgatgatgcaatcagcccccatgtgctggcattctctgcgtatctcgcccacggatttgaccccgcttgatatccacacatccagccttttcagttccgtattggccttttggaaccgttctttttcatcccccaggaaagccttgccctgccggatacggttcatcataataccagattgccgcgacaccagtcgttcatacatctgcttatttgtcatttccagattatacagcagcacccgcttgccctggattcccatattggtcagtatttgcgtaacaaaagcagattttccaactgctgggcgcgctccaataacaatgacatccccaccctccagacccccaagacattcatccaatcgtgtgaatcccgtgtaaagaaaatcccgttccctgtccacaaaacatcctggggccatttcgtcaacaatctcacttaagctttttgcctttggtctatcatcctcctgcaatgcctccagagcgttcacagtctcccctatttgcttttctacggcagatgggtggaattgtactgcattgataatttgcgtggctgtacgggccttatatgcgtttttaatcacatctgcatattccccagccgcagtgcttgtcacacttgaatcactgcactcttttaatttgctcagtaattcagcttgggaaacatcagcaatatttgctgcaagggttacaagattggcctgatatccaaaatcatgcgctctcaaaaattccagatatatcctacctaacagcgcgtcaacaaacatatcagggcgaatgctcccacaatccttgattgcccgtggttccatcatcaaggcaccaataagcgcttgctccgcattaacaatcataaatcatcctcccccggcagataatcaataatagcctttgacataaatgtatcgaaatttttacaaaagcatatctctgttccctctgcctcccattcacgggtataggcccgaaccgccaaataaatttgcttgttagtcagccgataacgaactttgttgatacagcgcccctttttcacataagcacaatagtattcaaatgcttttgcttttcccctctttttgggatatatggcataaatcttttcaaagtctgttttcagttgttcaaggtcggaattattatctcccgtcttatctggttcggctccaggcgaacataatatatttattttattatttacattattgtttgtgtgcactggtcgttcactggctgttcgatggtcgttcaattgcgttacattctgatgttcacacatttggtacatatcccagttttttattgtaattaggcgatttctattacctgtctgttgttcaatctgctgttcactttcgtaacactttaagacacgctgtactttcgattccgtgacacgcaatttgtcagaaatgacctttctgcctgttatcagttgaccaggattaagcattattttttgccctttaaacatagcaggaatttccgcatgggttgcattaagcagaagataaatccaaatagccatataatccgaatccttacatactacaggattatctaacatttttctatgtaagctcacccagccattcaagtttaatcaccgccattctttagccctcatgcattagccccctgtccattcagaaaatctaccagtttgccaaaattgactaaatatttcgtcccaaccataacaaacgttattttcttctggaggcataattttcttatgcaatcataagataatccggttctctctgctgccttacggatggtaagcatttctggaatggactgctcctcctgcactggaagtttaatagccgcttctaatgccgccatctcattaagaatagccttttcctgcctttctgtgtttgtgttccaacaggaaccggattgcaagaaaagttctgaacgctgccgcgctaagtccgtatatctggaaaccatttccatttttgtcataaatctaagcttgctcctttccattcatccatgccgcccagcatatttctattctaaaatttcagttacatcaacctctaacgcatctgcaatcttaaatgcagttcttgcctgacaattctttccgttaataagagtagataaattccccctactcatgcctactttgtctgcaaggtccttctggtacatatcatgttttgccataataatttccatcttagttttacacagtctcataatccacctccttatggaactatttttagttctatttatattatatagaactaatttcgatttgtcaactatgtgaacagaactatttttagcattgaaaaaacatttcctatgtgatatgcttaaagcatcataagaaaggatgtgggtatatgaaggccagtacattattaagaattggtgatagcatccgtatcctaagaaaaaataagggttggacgcaaaaaaagcttgctagcgaaagtggcattcacgaagtacagattcgcagatatgaaaacaatcaatcacttcccagagatgaacaattacaaaaacttgctagtgctctaggagtcgaaaaagatttttttacacgcatggataacatacaaaaaactgttcaagccgccaaagcaatggatgaaaaggcaaaaaaatccttttctgcacaagaagtatttattttaggaaaagacaaattaagtctaccgataacaacgtctactcaagctcatttgtcatatgaagaaacagaaataaaacttcataacaatgatagtatctataatcatgaatatcttgacgacatgaagtttaatggtattatgcaaaaaactaaccgtggagaagagctgacaccgcaggaatccatattcaaatcagcttacctggcaagagccttaagaggcataggagattctttcgcacaatattatgcaatgttaaacgaagaaggtcaaaagaaagctgacgaagaaataaccagaaccattaaacagctagaattgcttacgaaaataccggaatacagaaaaaaagactaattaaccactattgtcaactatcaattttccattcatccatgccgcccagcagatgaaaggaaggatattatggcaagtgtaagaaagcgcggtaactcttatcaagtcacggttagcaatgggcgcagagccgatgggtcccaaatacttgaaacggaaacattcacaccagagccaggaatgaccccaaaacaggagaaaaaggccctggagcaatttgtaatggactttgagcgtgatgtaaaatcaggccaaaacgttaaaggccggcgcatgactttggaggaactatctgagttatttttaaaagacaatgaacctacaggaaaaccggatgaagatattatgtccatcactacctgggccagctataaaaactgtttgaaattgcgcattgtcccacgcctggggcatttaaagatatgcagcatcattccaaagaaccttaaggattacagcaaagacttaaggcaggacggggccaggattgacggaaagcccggcgggctatctgaaagcaccataacaagggattgcgccattgtcagcagcttattgtcttatgccgttggtgagggattacttaccataaactctttaatctatgctggaaagcaaagcaagggacatagacccaagaaagagtataaggtgaaatatcttaccatagagcaaacacaagcgttcctgtgggccttagacaaccctataacgataaaatacggaggccgtaagcgtaaaaacaaatcaggggaagtatattcaatcaaagaatatcaaacgtcctggaaactctctttaaaatggcgggcttacttttatctggctctatttattggtgacagacgtggtgagaatatagctttcacatggaatgatatagatttagataccggaaccgtgaatattgaaaactctacagcttatgtggatggaaagataatacagaaaaagaccaaaacaaataaatcacgcactcctgttataccgcctgttgttacaggcatattgaaattatggaaagcggagcaaatgcgccaaagcatggagcgcggcacatattggcagggataccacgggaaagaatttgataagaattttatcttcacacaagaaaatgggattcaaatgcacccttcaagcccataccatcagtttaaacgaattatagaactgtataacaaatatgtggcagaggattgcagccacatgatacccccggatataaccccacacgatttacggcatactgccgcatccatattgattgctaataatatggacccgcgctccgttgccggggttctgggacattccaatgcgaccaccacattaaatatctatgcctactttttccgcagcaagaatgaggaagcagctaacatcatggagagtgttttaatcaaggcaaattagtcaatgttagtcaaatgttagtcaaatcaagaaaaccgcccacaccggacggtttttcttttgctcaaatgttcaattttccttgtaaatacgtacttttttatcaagccactggccggacttgaaccggcgacccacgcattacgaatgcgttgcgctaccaactgcgctacagtggcatccgaacagcaattgccattcctttgatgcaacaaggctgctgcctaagcaacagccttgccatcatgacctgaccgggaatcgaacccgggtttacgccgtgagagggcgtcgtcttagccgcttgaccatcaggccttaaggtaaatcgaggcgacgtgattcgaacacgcggcctctgcgtcccgaacgcagcgctctaccaaactgagccacgcctcgatacctttggtagtataatacatttattccagaaagtcaactataaattgtcaaaatttttaaaataactttgataatttctgtaacccctggctgcaggctcagtactacacttccacggctgtaaatccaaggtcatctaaaatctccacagccctggcttcagcgtccgtgtctccgtcaacagtcactgtcttgacagataaatccacggtattcttaatgccggctccgtccagccccttcttaatccggtttacacagccctcgcacatcatttcctcacacttatacgtcttcatattcattctcctttactatttttattaacaggccttccctgattcctgctccggggcgccatcctgtttcactgtcatcgctgcatctgcaaaagaccctggcggttttcgcttattcttccctcattcataaatgctgtcataatcatagtttgcgtaaaaatccgtgattctatcaaaatacccatccacattttccctggtcagcctgtgctcgccagccgccatccattccagaagccggtcccctatgtcctccgagtagtgaatcacgtccatgtaatggtccagattgcaggtaatgtcaaactggtcgtcaaaagcaaagagccggatattgctgcattccaggagcatggaggccatgagccggtatccctccatctgacgttcaaactccccctttaccatcagttcactgtcccaccagctgatgctgtagggcggaatgaagtaataaaaggtgacctggggattagcccttgccgtggccagcacattctgctccagattctccatgaccatccggcggtcctcttcggtaaagagggctgtttcctccctccggggctcccgctcgtatgtctttaagacagcctccctgccccagtcccgttccggcgcccagtgcatgtattcgtcaaaggtggtggtctgctcccccgcccttgtcctggcaaaaacgcccggaatggtaccgaatatcacttctttattgaaaatatagttcacatcattaaatgggtttccatccagcagataagcgggagaaggggctgccggattccactcatccttgggataaaacaggaaactcctgtccaggctcctgcacaccactctaatccggggctggtaggcaatggcccgtctgacagcctggtccacctccttatagtatccccctgcataaggtattttgatggatgttacgccgaaaagactgtcaaagcggctggccttaaaattctccatcatggatgttcctgtgagcactgcatcatatgtaaaattgcggctgattccgtcattctggtaccgctcgctgtcaatgggatatgccagatgcccaaggggcttatgataatggaaaaaggggtccacataaaccaccattcccccaattaaaaccagcatggccagtacggttcccaaggtaaaccgaagccatctgccatagctgttatcttctgtccctttcctctgcttttgtgtctccaatcctatctctcctgtagctgtatattatgccttactgtctgtaagccgcaaacctgtttaaaattgaaaataaataaagctggatatccctgccagtgacagaaccgaccacaccaaaagaaccgctgttcccgcccccctgagaagggtggggcgaagctcggtctctcccatattcctggcattcatcaccagacagaacacggctccatacagtcccagcacggtaaatacccggtgctctgtcagccatagaggcagctccgccatcttaaaactgtccatgaaggatgggttaatctgcatgtttccaaaatccagcagccgtttaaaaaacagctttgcctgggctatgctttctgacctgaatataacccaggtcaggtttacaaacagaaaggtggccatccactgaaacgccgtgtgaagattctcccactgctgttttaacatccggttaagggcctgggcagctccgtgaagggctccccagagaatgaaggtccaggcagctccatgccagaaaccgcttaccaggaacaccaccatgatatttatgcaggtgcgcataggtcccttcctgcttcctcccatgggaaaatagatatacttcctgagaaaacgggtcagtgtcatgtgccagcgcttccagaattccacgggagacagcgccttgtagggcgaattaaaattaaggggcagttccaggttaaacatcctcgaaattcccatagccatatcgcagtagccgctgaaatcaaaatacagctggaaggtataggccgtcataaccaggaacgcatccgtggaactgagtatctccacctgggcaaatccccagtttaccggtcccgcaaaaaactctgccaggataacctttttaaacagccccactgccagtatcatcagcccctcggccagatgaccggaatccgccttccggcggcacggttccctgagctggggaataaattccccgtgcaggagaatcggccccatggcaatcttgggaaaatacacggtaaacaggaaataatcccaaaacccatatccctctgtctccatgcggaaggaatccaccagccatgcaatctgctgaaaggtaaagaaactgattcccaccggaaggagaagccttgtaaaggcaatgtcctttcccaaaaatgcattcaggttttctataaagaaattcatgtatttaaaataaaacaaaagggccaggttggcgaagatgccggatatcagcagcagcttccggccctgtccgcggcccgggccgctgtccgctccgccatgccctgtatctgtccccctgcttccgtcacgcaccagcatcctggagacagcccagttaaacactgcgctgcccaccagaagtcccagataccatggattcccgtatgcgaaaaataccagggacatggcggccagaaatcctctggcccaggtatagcgcttcatccggcacaatccgaagtagccggccagcacagccggaaggaacaacaataaaaataaatatgaattaaactgcatgtatcttctgtttcctttatctcaggtttcctgttatttcatcattttctgcagggttctgcaaagctcctccaccgttgcgtcgctgtcgcccttaagtatgtcatccaccacgcaggtcttgatatggcgctccagcagcaccttgttaaagctgttgagagcggcctggacagcggcaacctgggtgatgatatccacgcagtagcgctcatcctccaccatggatttaatgcctcttatctgtccctctatccggttcagccggttcataagcccgcgttcttccgaaacttccctgtgtttatggcggcagccgcagccttcttcctgattcatgtattcctctccttctgccttcctgttatcccgggcatgttaagacataccctacagcttcagattcctgagcctcagggcatttcccaccacgcacaccgagcttaaggacatggcaaatcctcccagcatggggcttaaaagaggaccgcccagcaggtacagcacaccggctgccaccggaatgcccaatgaattgtagaaaaatgcccagaacaggttctgcttgatattgcggatggttgccttgctcagtttaattgccctgtaaacatccatcaaatccgacttcatcagcaccacatccccggactccagggcgatatcgctgccgtttccaatggcgcagcccacatccgcctgtaccagcgccggcgcatcgttgatgccgtcacctaccatcataactgtttttccttcattctgcaaccggtttacaacctgggccttgtcttccggaagcacctcagccaccacctggtccacatgggccagctttccgatgtaccgggctgttctctcattatcgcctgtaaccatgtacacagccacgcccaggctctttatcttttccactgcctccacgctggtttccttgatggtatcagccacgcacacaatgccggccagccgtccgtcaatcaccacatacataggggtctttcctgtattggcgtactctgaagctctcttttccgtatcctgggataccggcacatgcaggtggtccagaagacgccggttgcccaccgccaccttccatcccttccatgttgtgatgatgcctgctccggtaatgctctcaaaggcctcgggcatcaccaggtccatctgcttctccctggccgcctgtacaatggcctggcccaggggatgttccgacatctgctcacaggaggccgcgattcctaaaagatgttccttgttctcatcgccggaggcctttgcttccttggtgctgtcctttgcggctattccctcctggttctcatccgcggcaggcggcacagagccgggcacagaggaagattccagcttccacacctgctccaccacagcagcgctgattacattcacatccgtcaccctgggttttccctctgtaatggtccctgtcttatccagtatgacagcgtccaccttatggcaaatctccagggcctcgccgctcttaatcaggataccgtgtccggctccgaccccggttcccaccatgatagccgtgggagtggcaagccccagggcacaggggcaggcaatgaccaggaccgccacaaatatggtcagtacaaaggaaagctcctttcctccaaaaacccaccacagcagcgctgctgccagggcgattcccatgacagcgggaacaaaatatccggccaccttatccgccagtttggaaataggcgctttcttgccctgggcatcctcaatcattttaatgatttttgacagggtggtatcgcttcccacatgggtcacttccacctccatggccccgttgtagttcatgcttccgccaatcacactgtcccctgtctgtttttccaccgggatgctctccccggtcagcatggactcgtccacgctgctgtttccctgtacaagtataccatccaggggtatacggctgcccggtttaatcagaatatgctgcccgacagccactgtggatgtctccacttcccgctccgtaccgttctcatagagaatggctgtgtccggcgccagctccataagcttgcggatggcctcggaggtcttgcccttgctgcggctctccatgaacttgcccagcattaccagggtaactacaacggctgctgattcatagtacagctgatgggccttcatgtggtcccccggaatacctatggtcatcacaaggctgtagataaatgcgcttcccgtaccaatggccaccagggaatccatgttgggattgcccttaagcagggaacggattcccaccagatagaacctgcgtccgcaaatcaggaccggcacagtcagtataagctgggccagggcaaaattaagcggattcttatccatctccataaacgcgggtaagggcagggtaaaaggcagcatatgtcccatggagatgtagagcaggggcactgcaaagcagacagcggtaatcaccctgcgctttacggctgccagctgttcctcctgctgctgccattcctcctcttccttttgcttgttctgttcttcctccacaatcaggctggcagaaaagcctgccttggataccttctcgcaaatcatctcaggcgttacctgtccttcatcataggtaatcaccatccggttggtagtcaggttcacattactgctctccacaccggttaactttctcgtaacgcgctccaccgcgctgctgcatgccgcacaggacattccgtctatgtgatattgttgcgtagtcatatgtttcactcctttcctataccccacctgggtatattgcaattatagagcactaactgcacattgtcaataggtagtatgcccaggaatgaaaatctttactatttttgctgattcttattgattttccaaaaaaaacaggcagatgcctgtcatttcttgggcgccgtcactgccatgcaatacctcgccagcgcatagagggtgaggagagctgctatgatggtttccgcagcaacggcatatgccaaagctggcgccggatgccccatattgccaagacaggccatggccatcttaaggccaatggctgtgatgacaaatggaaatgtgaatgctgcataactgggataaaatttcatcttcagatatgccggtgtctttattagcactgcaatgtatatgactaaggttcctgaaacactggccatgatgggattcttcatgtcctcggcaaactggccggggtataatatgtttttagccacaatcagaagccccagaaccagggatactgccccacacaaaaggcggactccctcggaataggactggagcagatttcccagggccgccatgcccagcatgacgcctgtggccggaagaggtattctttttatcatctgcgtacgctcctattcgtcaatattcgtaagtcccttttcccgtataatcatctcagccaccttgcctgccaccaggcccgtgaagcggatgcactgttccttatgctctcctgcgcccatatcaaattcctttgtgagaatacggcagcacagcgcataattgctgcggatggtacagacaactgcttccgaacagaagaagcctccccggaataaatcctctgcgtcctgtgtcccattgtttttaataatacaaaaccagatgcaatagagaaaaacaatgcccttacatggccttctccaaaagccgtctgaacaccaataacagtactgcaaacagtgcagccacaaatatcagcgtctttgcaactgtcatactgataaacccgcttaccaggacgcctatatagagcatgaacatcatggtatatcctgtgtaggcccagcaccgcagacccagcatacggttcctctcatccgtctcatatatcctgcgtttttctttaagctccgggtttctcagatactgcaggttgcggataatggatgccgtaccggctgcagccaggccaaagccggtcccgccgtaaaatcccggcatgaattcccggtatccctgctccagatacatcaccatggcacggttcctgactgcaaaggacagccctatggccgctgcgcccaacaggataaagcatattccaaatacaatcctgttcctgcatctcttctcaaaatcaatggggttttcaataaataactggttcagccacatattcactcctcctcttcaaataaaaatatatcctcaatgctttttccgaaaaatcttgaaatcttaaaagccagctgcagggaagcattatacttcccgttctcaagggatattatggtctgcctggtcactcccagggcagatgccagttcctcctgggtgaccttgttctgttttctcagttcctgtatcctggtcttcaatcacaccaccctttccgctttgtatttttacataggattcctttccggttttgtattgtctgctccggccttttaatattgcctgctgggtttttgtatagcctgtttctctttccgtgcagccggccgcatatcaaaagtatggtttcctttacatttttagtatagtatactttacataaaatgtcaagctgattttacattttgtttcctgtccggctaaaattccaccgcacaaaaacagcccccggggattccatttacagcgaatccccaggggcagccctgcgcatcaattccgattttatcttttatccgttaaaaatcacacctaattccccataaacttggaagcatatccctgtataaatatgccgagcacaatcaatggaaggatatagctcacataaaccctggcccatgcaggaaaaggaatgccctccccttcattggcctctgccatgaatttcttaaagccccacccgtaacggctggtgcagaacagcagataaagcatgctgccgatgggcagcaggttgttgctgaggataaaatcctccaaatccagaaccgtgcttccctcccccaggggagcaaagccgctccacaggttaaagcccagcacacacggaacagacaggataatgacggctgctatgttgcagagaaccgccttcttaatggtgcaccccgtcaaatccgttgcaaaggaaatgatgttctggaacactgcaatgatagtggaaaaggcagcaaaggacatgaacaggaaaaacagcgttccccagattctgccgcctgccatgtggttaaatacattgggcagggtaatgaaaatcagggacggccctgctttggactcaatgttataggcaaagcaggccggaaatatgataagtcccgccatgaaggccaccagggtgtccagcagggtgacgctgatagcttcccctgtcagagtcctctccttgccgatatagctgccgaagatggccagcgctccgataccgatgctcagcgtaaaaaaggattgtcccaacgcggcaaacacggcttctccgatgcccgcctccaccatcttgccaaaatcaggcttcaggtaaaactccagtccgggaccgcctcccggcagaaccatggagtgaatggccagaaccaccagaagcaccagcagacacaccatcatgacctttgtaatgcgctccacgcccttctgaaggcccatggcgcagactccaaagcacatgaggacaaccaccaccatgaagccgcccatgagccctggattggccagcatgtttccgaattcaccggccactgcctctgaatccataccgccgaagtcccccttaagggtcttgaagaaatagagcatcatccatccgcccaccgtggtgtagaacatcataaggatgtagttgcctgccatggcaatatacttggtcagatgccacttgctgccctccggctccaacaggtcaaaggacagggctgcgctcttgcggctggcccttccaactgcaaattccatgactacgatgggaagtcccagtatcagcaggaataccaggtataccagcacaaaagcggcccctccgtattcgcctacaatataagggaaccgccacacattgcccagaccaatggcgcatcctgcgcttataaggatgaagcccagcctggacgagaacttttcgcgttccatctatatatcccccgtttcgtaatatgacatgagttaccggactgtttcggacagccggactcaataaaagagcccttaatcctaaggactctttcatatactaccataatattacacaaatatcaacctgtctctgtcctttgtcatagggaacgccggaggctgcctataaatcaaacagggataactgattggattttggaaggtccttcagcagtcccaggtccgacatcagggaacagagggtgccgtttaccttggaacggttgctgaaatcctcgatggacaggaaggcgccgtccttgaccgcgtccaccacagcctccgccgccttctcacccagtccgtcaatactgctgagggaaggcatcagcttgccgtctatgatttggaaatgccttgcctttgcccggtaaatatcaatgggcgtaaattcaaagcccctggcatacatttcctggacaatacgcatatccctcaaggtatcctgctccttcttggacagggtgtccgccctcttcttataatccgccagatagtattccagcttatcccttccctggcacatgatttcataggaaaatgcgctggcacggatactgaagaacgcagcgtaataagccaggggatagaatattttacagtaagcaatacgccacgccatcataacgtaggcagccgcatgggctttggggaacatgtacttgattttcttacaggaccagatataccagtccggaaccccgtgggccttcatctcctcctcccactccggctttaatccctttccctttcgcacgctctccatgatggtgaaggaaagtccctgctccaggccctgggcaatcaggtagaccatgatgtcatcccgggtacagatggctgtctgaatggtggcctttccctcctgaatcagggtctgggcattgcccagccacacatccgtaccatgggccagaccggcgatacgcaccaggtcggaaaagtacttgggcttagtgtcaagaagcatctgcatggcaaaatccgtaccgaactcaggtacgcccagggcgcccagaggacagcccccgatatcgtccggcatgattcccagggcagatgtgtcctggaacaggctcataacctcccggctgtccaggggaatatcctttacagggtcaatgccaatcaggtcctgcagcatacgaatcatggtagggtcatcgtgtcccagtatgtccagcttcagcaggttgtggtcaatggaatggtaatcaaaatgggtggtgaccgtggaggtggtcatatcgttggcagggtgctgtaccggggtaaaggaatagatttcctcccccagcggaagcacgatgatgcctcccgggtgctgtcccgtggttctccgcacccccacacagccctgcacaatgcggttaatctcacagttacgcttcctggttcccctttcctcataatatttctttacatagccaaaggctgtcttatccgccagggtgccaatggttcccgcacggaaggtctggccctttccaaagataacctccgtatagtcgtgggccttactctggtactcgcctgaaaagttaaggtcgatatcaggctccttgtctcctttaaagcccaggaaggtctcaaacggaatgtcaaacccgtccttttccagaggtgttttgcacacagggcattccttatccggcatatcgcatccggccataccggagaactgcttcacttcttcggaatcaaagtcatagtaacggcacttggggcagtggtaatgggggctcagcggatttacctccgtgataccggacatagtggccacaaaggaggagcctacggagccacgggaccccaccagatatccgtcctcattggacttccacaccagcttctgtgcaatgatatacataaccgcaaatccgttggtgatgatggaatgaagctcccgctccagccggtccacaacgattttaggcaggtcctccccgtacatctcatgggccctgtcataacatatcttggtcagcgtcttgtcggaatcctcgataacaggcggacacttgtccggccgcaccggtgcaatccgctcgcacatatccgcaatcttcctggtgttggtaactaccacctcatgggccttatccggccccagataggaaaattcctccagcatctcctctgttgtcctgagatacaggggggcctggtcatccgaatccttaaatccctggccggccataatgattctgcggtatacctcgtcctgggggtccaggaaatgaacgtcgcaggtggcgcagaccagcttgttaaactgcattcccagttccactatctttttattgatatctatcaaatcctcctgggttttcaccgtgctcttctcgtcccggagcatgaatgcattgtttcccagaggctggatttccaggtaatcatagaaattcacaagccgggcaatctctgtgtccggtgcgccgcggagcagggcctggtacaattccccggcctcacaggctgaaccgataatcagtccctccctgtacttctccagcagactcttgggaatcctgggccttctggcatagtattccagatgggaccagctcaccagacggtacatgttcacacgcccgatgtcatttttagccagaatgataacatggtgggtagggagcttgcgtatggtatccgtgtccatggtgctgagggcattgagctggtttaagtcatttacatcccggtcccgcagcatcttcacaaaggcggcgaatatttccgctgtggcgcctgcatcatccaccgccctgtgatggttctgcagggaaatgttcagggccttggcaaccgtgtccagcttaaaacggttcaggttgggcagaagaagcctggcaatggcaaccgtatccagcaccgtgggattgaaaggaagctccagttcctccgcaaaatggtctatgaatcccacatcaaagcttgcattgtgggctacaaggactgcatcccccacaaattccagaaattgcggcagaaccacatcaatttttggggatggaagcaccatggaatcgttgatgcccgtcagcttctctatgtcgaagggaatggggacatcgggattcacaaaggtggagaatttatccgtaatcctgccgtccgtcaccttcacggcgccaatctcaatgattttattcttcttggggctgaagccggttgtctcaatatcaaagaccacaaaggtatcctcaaacccctggcccctggaattctccaccagctgtttggtgtcgtccaccaggtacccttccaccccgtagaggattttaaaggtatcccccttgtccagggcatggttggcgtccgggaatgcctggacacagccatggtccgtaacggccacggcaggcatgccccactgcctggcccttcctatgatgctctttacctcggacacgccgtccatgtcgctcatcttggtatggcagtgcagctccacccgcttctccaggctggaatccatgcgcttgctggtaaaatcatccgcctttttaatcccaacgatagagccaagggtcagctcgccgtcaaacttatcaatggtggtaacgccctttaccttgataaacatgcccggtttgatggcggatttcacctcgtcaaatatctccgggcggatgaacatcttcactgtgatggtatccgtaaaatccgacacatcaaaggtaaggatgaatttgccgcttcgcagctcccggttctcacaggtcagcaccttgcctcttaaggttacctcgccgatttccccgtcaatcttctcaatctccatgggctcgtcctcaaagtcccgcccatagagcacatccgggttgttggaacgcttgacggaatatttcttatcatcgccgaaaccattgtccttatcccttccccagcctttgcgccccttgttgagctggggcttatctcccttaaagccctgcttctggccgccgccctggcctggctggcctccgtttcccgcattgccgggctgggcagcagcgcctgtctgtcccccattttctcctggtgcagctccatctcccacgtcgccggaggcagcctgggccataagcacatcccatggagcgccctccggtccctggcccgcatccagataggaatccttaccggacttgccgtcctttcccgccagcagctcctggccctccagtccctgggcggaaaaggaggcgtccattgcttccagctcttccttgtggttctgccagtatatggcctgggcctcccgctccatcttaagctcaatccgtctcctgcggtcgctgccctgaggctccacataagcaaagcgcacctccacaggcagcccgcaacgctccgcaaagaccttttccaggacacgcttcagttcccctgtcctgtcccggttcaccatggtatcctccacagtcagaaccatgatatcctctttttcaaaggtaatctgagccttgcggaacatggtatattcgatgatgctgtaatttttaagttccagaagcaggctgtccttatacacatccaacagcttctttggcgtgtactggtctgacagcctgtatttttcctgaatcttgatagccacctgcttgtccgggaacagctggtcccgtatgcccttttccaggtcgtatatgttctgtttatgtatcagtcttgcgctcttcagataaatgcggatagagcttctatccctggtggtggtcaccttctccacctggaccaggcctaaaagctcctttaatgattccgctatattgagggttggaaatacttccagaaaattctttgccatatatccgtcttccttctatacatcacgttcccggctcatggactgcagttcttcccgcagcactgccagaagctcagactcaggcaccttgcgtatgatttcgcccctgcgtatcagcaggccctctcccacaccgcctgcaatgcctatatccgcctccctggcctcgcccggcccgttgacaacacagcccatgacagccacctttacattcaggctgtcaaactctgtcaccatgttttccacctggtttgccagaccaatcaggtcaatccgcgtgcggccgcaggtgggacaggacaccacctcaatgccgccttttctcagtcccagggtgcgcagaatcagcttggcgctctttatctcctccaccgggtcccctgtcagagatacacggatggtatccccgataccctcatgaagaatgatgccaagtcccacagaggacttgatattgccggacatcagagtgccggactccgtgattcccacatggagggggtaattggtctgcatggcaatgagctcatgggcctttacgcacataagcacatctgaggacttgatgctgataaccagattgtcatatcccatgtcctcaataagcctcaccttgtccagggcgctctccacaatgccttctgccgtaactcccccgtatttttccagaagcggtttttccagggagccgctgttgacgcccacccgtatgggcaccccgtattcccttgcccggtccaccactgcctgcaccttgtgacagtcgccgatgttgccgggattgatgcggattttatcggctccgttctccatggcggcaatggccagacggtaatcaaagtggatgtccgccaccagcggaatacggatttccctcttgatgtcagacagggcagccgctgcttccatggtgggaaccgctacgcgtatgatgtcgcagccggcctgctccagcctgtgaatctgctccaccgtggcccttacatcctctgtctttgtattgcacatggactgaatcaggacagggtttcccccgccgatgacccggtccccaatcttaatcacttttgtatctttcctggtcatatataccctcttttctgatatggaacaatgtctttaaaataatttccggacatcgttaaacatgataagcaccataagggccagaaggaccatcattcccgccatgtggaccatgccctccttttccttgtctatgggctttccccttacggcctcaatgatgaggaacacaaggcgtcccccgtccagggccggaataggcagcaggttcatgacacccaggttggcgcttaagagtatggtaaagttaatcagcatgagcaccacggccgacagcccatagggcgcggtctcatccaccgttgtgtcaatggcgttcacgatacccacgggaccgctgatgtcattgaccgataccatgccgtggaacatcatataaaaggtgtcgaacacatagtgtatccagtactggacctcgtaggcgctgtgcaccagaagctgtcctaagttctccactgtattgggaaccgggtcaaactggacacccatcatatactggttgttctccgctgaaaaaacaggagccagctctgtgctgaagcgctccgtccctccgctctcacctgtcctttcccaggaaaccttaagggatttccggggatgggtaaagagataccagttgatgtccctgtaagaatggacatttctcccgttaatggatttaatcacatctccggcctccataccggctgcctgggccggatatccgtccactacgcctgccaggcgggtggtgtcaaatccagtgatgccgatgagcaccatggaaaggccgaaagccaggataaaattaaacacaggcccggctgccaccacggaaatcctggcccatacggacttgttattaaacgcactttcgtctgttaccccctcgtcttcccccagcatcatgcaggagccgccaaacggcagtatcttaaaggaataccgggtgccgcctttttcaaagctgaacagccttggccccatgccaagggaaaattcaatgacccctatcccatttaactttgcaaacaaaaaatggccgaattcgtgaatcatgataatgattcccagcatcagcatcgcaataatcaagctcatccggctctcacctgtccatccggcgcactgccgcccctggtttcgtgcggcatgcgcctcctttctgtcttaattccattttgattttatataatcgtatgtttcctgttccgcctccagaatttgtgccacatccggggcaggcttcacgcagtggtgctccatggctccctcaatcatatccacaatggtaaggtaactgattttccgttccaggaacatggcaaccgccatctcgttggctgcattgaataccgtgggcagggtgccgcccctgcgtcccgcatcgtaagccagcttaagcccgcggaaggtatccatatccggcacctcaaaagcaatctgtgaaagctttgtgaaatccagccggtctcccggaaggaaacgccgttccggataatagagcgcgtactggatgggcagcttcatgtccggcgtacctaactgggctataacagccccgtcttcaaattcgaccatggaatggatgacgctggcaggctgtaccaccacctggacctggtccatttccaccccaaagagccagtgggcctccatgacctccagtcccttgttgaccatggtggaggagtctatggttatcttatgtcccatggaccagttgggatgcttcagcgcatcctccagcctgacctttgccagctggtccatggtaaatccgcggaaaggaccgccggaggcagtgagcagtatcttgtgcagcgcattgcctgccgccccctgcagacactggaagatggctgagtgctctgaatccacgggcagcagcttaacgcccttttccgcggccaggggcatgatgatatgtccggccgtcaccagggtttccttgttggccagggcaatgtcctttcccgcttccatggctgcaatagtgggacggattccaatcatccccaccacagccgtcaccaccaggtctgtttcctctgccgtggcagcctccatcaggccttccatgccgcttgcaacctttacatccaggtcagccaccgcagtgcgcagctgctctgccttttcccggtcccagagacaggccagcttaggcttaaactcacgaatctgttcctccataagtgttacattgccgcccgcagccagggctgtcacctggatatccttattgtatcttaccacttccaatgtctgggtgcctatggaaccagtggaacccaggattgcaatcctcttcatcataacttatattctccctatcctgaagaaatactcaaaaagcccatccttattttaaaaatgtgagggcaaagtaaatggcaggggccgtgaatatcatactgtcaaaccggtccaggatgcctccgtggccaggaatcagatggccgtagtccttaatgctgtggtttctcttaatggcggaagccgccaaatcccctatctgggaaataactgccgaaatggcgcaggcaatggcgcaggccgcctggggattctcaagctccgccatgctgcccccaaaaagggatgcgtaaataaggcccagaagggctgcgccggccacgcctcccactgctccttctatggatttcttcgggctcaggacaggcgccagcttatgcctgccaaaaagcatgcctgtacagtaggcaaaggtatcacaaccccaggagcttaagaatataagccacaccagatatgccccgtcgttcatttccctggtttgatacagaaatgacagcataatgggcacatagcatacgccgaaaaatgcgcctgtcacttcctctgtcttatactcagggaaggtaagcacgtaaagagccatcatcgccatcagacaggcgataatcataagcgtcacataacgctgtccctcaaaccataaaagcccgtaataggagcaagcagtcacatagcccacaacagccagggaacgccgctgcatgccaagagccctgtaaagctcaaataaaccaatgacggatataagggccgtaacggcaaatagcaggattcctccctgcccaacaatgacgatggacagaagcaccagtatgataccgctgattaaccgggtcgtaaacatggccttctcctttccctctccttactttacagcgccgaaccgccgttctcttttattatactgcacaatggccttttccaattcctcctggttgaaatccggccagagacaatccgtcaccacgatttccgtgtaggccagctgccacagcaggtaattggaaagcctcagttccccgctggtgcggattaaaaggtccgggtccggcattcccgccgtatccagataggatgcaaaaagcgcctcatccacctggtccgggtccgcctttccaagtgcgcagtcactggccagcctggcggctgccctgcggatttcgtccctgcctccgtaattcaccgctatgacaaaggtcagccctgtgttatccattgtctcggattccagacgtttgattccctctataatatccctgtcaaaacggcttctgtcgccaatcatccttacgcgcacattgttggcagacgcaatctttaagagccgcaccatataatagcggaacagctgcatcagcgctcccacttcctccgcagagcgtttccagttctcagtggagaatccatagacagtcagataacggattcccatcctggctgcaatttcaacggttttctccacggtgacgcagccttccttatgccccatggtgcggggaagtccccttttcctggcccagcggccgtttccgtccaatatcagggccacatgctccggtataatcatatccttatccaatgccattctttctctgcctttcttgtccaaatgtatctctcccaaacaatatctttatcatgtcatatcgttccggaatcaaaaaacaaattaagaggcaggagtccctcctgcctcccatattcatttatcacagattacacggtcatgatttccttggtcttctcttccactgccttgtcaaccttctctgccatcttatccgtaagcttctgcatcttctccgtcatctcggtcaaatcgtcctcggaaatttcccctgccttctctgcctttttaaaggcctcgttggcgtcacggcggatattgcgcagggctacctttgcattgtcgccctttttcttaacatccttggaaacttcctttctgcgttcctctgtcatctcagggaacaccaggcggatgcagtttccgtcattggtaggattgatgcccagctcagaagtaaggatggctttctcgattggcttaagaaggctcttctcccatggctgaatcacaatcatgcgggcttccggaacagaaacattgccgacctgctggaggggcgtaggcgtcccgtagtagtccaccttaatcttgtccagcacatggggattggcacgtcctgcgcggatggtaccgtagtcagacagcagcacatccagtgtcttattcatcttgtcctcataaaattttaattcttccataagttcctcctgttaatgcagccttccctgctgcttaataatgttcgctttattacgcagtaacgatggttccgttaatccggccctgcatggcgtttgcaatcccgtccttctcattgagactgaacactgccatgggcatcctatgctccatacacatgatggacgcggtcaaatccaccacggccagctgcttgtcaatgacttcctgtatggtaatcgtgtcatacttctttgcctggggattcagcttggggtcgctgtcatataccccgtcaatggccttggccagcaggatgcagtcagcctccatctcaatggccctgagggcaattcccgtgtccgtggaaaaatagggatgtcctgttccgcctgcaaagaataccaccatgcccttttcaaaatacttattagccctgtccttggaaaacagcttggtcatggaaccgcactcaaagggcgtaagaatctgtgtcatcataccggcattcctgaaaatctcagaaacataaatacagttcatgacagtggccagcatgccaatctggtctgcctttgtcctgtcaatggcctcactggtgcggcctctccagaaattaccgccgccaatgacgattcccacctgtatgcctgcatctacagagagctttacctgcctggccacttcctttaccgtgtcctcgtcaaacccggtcttcctggggcctgcaagggcctctccgcttaactttaagaatacgcgtttcatcttcataaagatttatctccttgctgcaatatctgtggctattatagcatagttaggtcaatttgcaaagaaaaagaaattatttatccttttttccatttcgtctaacatttcataaataaaaattgagattttctggcttttatattataataaaggaaatgctaatgcagacaaacgctgtctgtgaatgacaaaggaggaaacaatcatgggtttgtttcagcataaaaaagaaaaaggggcggcagagcttccgccgtcacagccttcctttaccccgtctgaaccggacggcgccggcgaaggccgtgctgcctgcatcagcaggctggagtccctgttaggcgcaccctcgtccaaaggcgtggtgttaaagctttatctggagaattttaagagtctgaataagacattcggatatgattactgcgaggaacttctgtcccagataaaaagctatctgaaggaagtggctgagggtaatatctaccgttacataggcgtggagttcatcattatattggaacagctctcagaggggcaggcttccgacctggcggacgagatactggagcgcttcggtaacgtgtggaaaatccgcggcgtggactgtctgtgttccgcacagataggcctctgctcctatcccggccacgccgccaacacagacgagctgctcaagcgtctggacctggcagtgtccgctgcatccgactgcggccccaaccagatggctgtatatgacagcaacatgcatacccagtttgtccgccgccaggctgttgccatgtatcttcaggctgccctggaaaagaatgagctggaggtccgctaccgccccacctataacctgaaggaaggccgttttacaagggcggattcctacatgaggattttcattcagggaatcggactggtgggcgctgctgagtttatgcccattgcagaggattccggccaaatcagagccattggatactacgccctggaccacgccggcaaatgcataagcgagctgatgaagacaggacgggactttgattccatctgtatccctgtttcccctgtgcttctggtacaggaggattttctggaccaggttacgcaggtccttgagacctaccagatacccaagggcaagctggctctggaggtggatgacagcgccctgtccaatgtctatctgaacgttaacatcaccatgcaggagctctccgacatgggagtggagctggtgctcaacaacttcggctcaggatgcgctcctgtcagcagtatcctggaccttcccatcaacaccgtgaagctggagcgcatgtttgtatggcagctggaaaccaatccaaagtcagcctccattgccggcggcctgattcagattgccagggagctgggcatccatatcattgctgagggcgtggagacagagaaccagctgaacgccctgaacagctaccagtgcgagtatcagcagggcttctactacgctcccaccatggagcaggatgtactaatgaaggtcatgggtaccaccctggatgaatccagggttaccattgaggaagagaagcttaagatgaaaatgtaaggctgaagctgtaaaagaacgcaggttccgtttccagcggttcctgcgttctctgtattgttatgatttttatcacctacggcttccactgggcataaatggattcattgatgcctgaatgtatggtcagctcgctgtggtcatcctttaccagctttaccctcctgttgccgtacaggaagcagcgttcctgcaccacctgattcatatttgcaaacaattcatcatagatgtccgtaatctccccgcctatgtaaatgtattcagggtccatcatggtaatcaggacagaaatcagcctgcccaggtatccggcggtttccagaatcatattggctgcctttgtctcacccttcttcgcatcaataacaaactggttccaggcttccagaacatcctcctgctcttttccccaataatccgccacaatgtcgggaatggcaagctcattctcaatgcagccgtaagccccgcattcagaacaatacttatggggattgcccaaaggtgtatgggccacctctccgccgtacccgtgatggcccctcagcagggagccttcacagataattcccacccccaccccctcggagatatggaggtagaccaggttcctgcactctgttatggtatgctttaggcttaaagcgcagagattggcctcgttgtcaacatagcccggcagctggaaggctttttctacaatggccttcagcggcacgccctcatacattttcacagcgcagtttacaagtgtctgggtagccaaatcaaagattcccgaaaccgccgcccccactccgatgtacacacggccgctgtcttcccttgcaatctcatcaaaccgcttcctggcaaaatcaatgacttcttcaggcgcatccaaaccggatatatcgtatttttgatggaatacaatttcatttctgatattcaataccgcgattcccagcacgcctttcatctgcaggttcagacacactgtacagaatctgttatatgccaggttaaccgtagatggagtccttcccacggacatggagttcttcttaacgatttcaacaattcctctctccaataactcattgcacagattggaaaccgtggcaaagctcaatgctgttctgtcagctatatcgcgctttgtaagaccgctctcccctgctgaaaacctcaacacatttacaatactcttaacattgtgctgtttaatatccattacgtctaaagattccatcgttttctccatctatcctcttaatttactgctggaggattctgatattttgccagtacggcctcgtcctttagcatctcgcctgtgagcaatgagctgccaccgtaaataataggagggacatggccaaaaggcggatttgctgaagggatttctgtggggtgtgccgctgcatatgccagcatcattgcctcgtatccaattaaatacgggtcgtccacgattgtcccttcaatatccccagcctgcagcagttcaataaccgctgaactgtaatcacttccaattataacaacattttctaaaatattcaatgttctagccgctgctgccgcacccggcgccccatatccatgggtgctgaatattcctttaatctgcggatttgcctggaacagggctgcgcatacggtttccgactttgcgacatctccttcatcgtttaattcagatacgacctgaacccccggcgcattctctgccagccattccttaaaaccagaagccctttcctcctgtgcaatggagcccggaaccaggcatatagccacctgtccctctcccccaatcatctcagacatggcctttgctgcgttggcgccaaaatcatagttatccgtgcccacataggacagccttccgctgtcggcagcatcactgtcaaaaccaatcacaggcacaccggcgcttaacgcttttcctatggctgaattcagggtggtttcatctgcagcggataccagtatgcctgccggttttttggctgtcacctgctccaccgcccttgcctccagtgacgcatcccattccgccggcccctgcagctccacgcttatatggcttcccagcagcgttgccgcgtccttcatacccgcataacaccaattgaaatattcagctccttttgtaaataccaccatggagtaaagctctttttccctggcggccgatgcatcctgcccggccggcggcgctgctgctcccgatgcgctgctgcatcccgctgcacttgccagcatgattcctgccatacacaatgcgataattttcttcatgaaattctcctcctcttttatgaatgcctcttttttaataggttcatcccctcgcttaacaacactgccacaatcaggaaggcccccgtcaccacatcctgataatacgtggaaattccgctcatgacaaaggcattgtaaatcatggccatgaacagggttcccagcagggttcccgtaaccgagccatatcctccgtgggtcaggcttgtcccgcctattgccactgttgtaattaccctcaggtccgcattggtgccgtaactatagcttgcactgctgtaggtcatggctgtgaggataccggctgccgctgcaagaacagcagatatgatatatacattccggtacactccctcaacctttattccggacagacgggcagcctcctcattaccgcccacaaaatatatctgctggaatgattttttgttttttgaaaagtaaataaagacagctgccagcacaatgtacacaatccagctcaaaggcattcccgcaaccctgcatgtgctccactcagaaaaaccttctgaaaaattagaaattgcgcttccgccggtaagggtcagattcagtccttttaacacagctgcaattgccattgtcaccaccatgggatgcagattcagtttttttctaaacagattggtcacgcacccaacgcctgctgccgctgccagcaccagcaatatggctgccgggaatgggactccctgtatcatgagcagtgcaaggatgatggaagaaaagggaaggacgcctgccacggtcaggtcaattcccccggatataattaccagggtcattcccaatgccataattgcctccataataaaattatccaccagcacgcagagattggccgctgtgaagaaataaggggaacaaaatcccatgaagacccccagaagtacaataaggaaaaccagcaccgcataatgaagattgatttttttagccatttccttccacctcctcccggaacgccgccttcatcacaatctcctctgtcagattatcattctccagaactgcctggcacctgccttcgtgcattactatgactttatctgaaactcccaggatttcaggcagttcagaagaaatcatccacaccgccatcccgctatccgccagttttcgcagaatttcgtgaatcatagccttggctcccacatccacgcctctggtgggttcatccacaatcagcagcctgggattcgcggcaagccatttgccaaagagtaccttctgctgattcccgcctgacagattggataaccggttttccatgcactgcgcgggatggatttccagttcctcaatatatttttctgttatactcctgctttggtcctcctttataaactgcattgggctgcagatggatttcagacaggctgcaatggtattctccctaacggtcatgtcaacaaatagcccgatagccttccggtcttccgacaggtagcacacgccttcttttatggcctgggccggattggaaaatttcacctccctttcctcaaaaaatacgtttcctgaatcaatcttgtccgccccgaaaactgagaatgcgcactcggtccgtcctgctccaaccaatccgaacattcctgcaatctcaccatatcggatttcaaaggatacattttcaaatttatccttcctgctgatatgctctgtcctaagtgcacatttcccgtttctgtcctttgctttcggaggatacagactatcaatattacgtcctaccatcattctgatgatggtctgtacatccatatcctcccttgtcagggtccctgtgcaggttccatccctcagcaccgataccttgtctgaaatccttgtgatttcatttaatttgtggctgataaatataatcagttttccctttttccttaaatcaaagagcagccggaacagattctcaatttctttatccgaaagagcgctggtgggctcatccagaatcaatatgctgacatcctttgacaatacttttgtgatttctatcatctgctgcagaccgacgctcagggttccggcctggacccttggattgatgctggcccctattttccgaaactcttcctctgtatttttgtagagacggttccaatctataaatcccagccggttgacaggctcattgttcacaaacacattctgggccacagtcatatttcctgcaatgctcaattcctgatggacaattcctattccatgggcataagcctccgccggattttgcatggatatgctcctgccgtccaagaggatttcgccgctgtcagcctggtatatacctccgattattttcataagggtggattttccggctccgttctcacctatgatggagtgaatctcccccttttcaaaatcaatggagatatcttccagtactttgttatttccaaaggactttactacatttctgacttgtaaataactcataccccatctcctatctcggctttcttctgcggcgcagggcgtcaaaggccactgccgccagaagcatcaggccgcttattgcagatgaccagttaggcgaaccgttaaacatgataaacacattatttaccagtgccaccagtatgaccccaagagcggttcccagaaaacttccggagcctccgtgcatatcagcgccgcctatgaccgccgccgaaatcgccttcatctcaaaagaaatgccataccctgcatgtcccataccaagactgctggtcatcagtatggctgctattccagccatgaggccgcttatcatatatccaagaataattgtaagccccgacggaatccctgagataaaagccgcctgcctgttgcctcccacgtagaacatgttgcgcagaggcctgaagcgcctggacagaaatgccagcagcagcatgatagtgatggataccagtatcttattgggtactccagccaggctgcccctgccaatgttggtataggtatctgtcagtcctgccacaaaatagccgctggtcagaacatagcaggtacccctgcagatggactggctgcccagcgtggcaacaaaaggagccacgttggctttggaaacaagaaggccgttaaccgcccccacggctcctccaaagagaatgccggcgccaactgccgcagctgtatttactcccttttgaatcattaaggtacagatgattccggccagcgcaaggacagctcccacggacaggtccacaccgcccaggataatgacgaacgtcatgccgcaggccagcagcaaatcataggcaaggttggaaaatatggcttcaatgttgcttctggcgtaaaaaagctctcccttgaggatacacattaaaacaaaaataattgctattgtaataattaatgttccttccctgttattgacagacagtttcattttgtctttcattcacatcacatccctctgcctaccagctcctggacatccaccggcatatcagaacacttgacagcagtccttccccgttttatatatgcatcctcaacacagcctcctgcaatctcagtgttgggataaccgtaacagccaaggtccagcatgatacctacattctctccgtagggttcctccttgtccggggtaatgaccattggttccaggcactctgtcagcccggttccatggcacgtactataaaaatggaactgcttcatattaagcccgtcaatggtctgtgaggcaaaatagttcctggctgccaggtcaatacggttagacggaagatgttcccggcagacatggtaaatttcctgttccgccctgcggtaagcctcgttcatgcattcaaaatatgcattctgaagccggcttctctctcccatgacaaaagaccttctgcacacacccttatatccctcaaagcttgggctgcagcctatctgtacgatttcaccttcctctattactttattggaggcaggtccaatcacggttttacagcggtcgcctgaatttacaatggtgtcaaatccgaatccggttcccccaagggatttgacggtaaaatctcccaccgccgccacttcgctttccctgattcccggtctggcaaccgccagcatggccctgactgctgcacaggcaatggtgtccgcctgttccatgcacttaaactcattctctgttttctcataccgcagctgcgacagaatatctgaggcatccgccacctccacttttccaaagctcgtgtgaagaaaatccatgaatttggccggaacaacatcatcacttgtcatatagccgatacgcttgatttcatgccctatgtaacgggaaatcacttcattgagctcatccctctccactccctcataatactcatcgggaatactgaattcatttacaaagctggtgtccagtcccaatcctgcttcctttgaaaggataccggattcaggtccggccagaaggaggggacgttttccgggagcaatcactccgctggccctttcgatggttggattatatccggtcagatagatgccgtctcccggcatctccctgtaccaaaagaaaaaacccatatcaatctccttttcctccagccttttccatacattccggtaccgcacttcatattcctccggcggaatcttgaaatccttgtcaatgcgcccttcatacgccttcacaattttcataaccctctcaaactccattgtacttatccccataactacctccttgatttatttgtttcttattattttaaactaattattataatacttattataattattatataaatatttgccaatactgcggggggataagaatctgatttccgtaaattttcataaatcgcggcaaaaatcagcaaaaaacaaaaaacctgcttggatttaaccccaaacaggctttcttcttaaacacaacacctttctttatttctccataggataaaccaggccccactgcctgcgcagctcatccatccacctcatcatacgcagcgtttcctcatgaggcatttcagggcattccaatgccccctccctgattgcccgcagacaggcttccacctcatattcatacccgctaatctgcttaggtgtgtcataggatgcaatcagattcctggaacggtcataaactttgatggcctcacagttgttgatgttctcaacttcaatgaatccattgtcaccatagataatgccacggcggtcgctgagtcccattgcgctgctgcacagaactgccatcctgccatccttgtaggtaatggtgatgctgttctgggcatccacgccggtttctgtcatcaccgctgtaccggttatggactccacctcgtccccaaacaccatggaggcaaaattaagcggatagattcccacatccaaaagggctcctcccgccagctccggacgcatgatgcgctcctttccgctgataatataccccagattggccgtaagcatataaggcctgcctatgacgccgattgacagcacgtcgtccaggttttttctcatgggcatgtaccgggtccagatagcctctgtcagaagcagtttcttttccctggccatttcaagcacttccctggcctgtgattcattgaccgtaaatgatttttcgcacagcacatgttttccgtgattcaggcataatttaatatgctcatagtgatgtgaatggggcgtggcaatgtacaccagctctacctcagtatcctccaccagctcctcataggagccataggctttatcaaagccgtatgtttttgcaaattcagccgccctctcatagtccctggcagccactgcgtagttttgcgcgcagtccatctctttaatggttcctgccatggtccctgcaattgctccggctccaatgatacctaccttcatatttataatcctcctgccgcaatgtttttatggacctgatgcacaggcccggtcattatgctcttctttgtattccggctctctcttatattccagccctctcttaaattccgcattcctcctaaattccgctttcctcctaaattccgctttcctcttatattccggttttctccgatattccggtttcctccgatattccgtactccgttatcttcccgttttcctgcggttctctacacgcattccccgtaaccacatggacatgcctgtatggaatggaaatacccgcagcgtcgaaattcgttttaatcaggcggcggatatcactgcaggcggtaaaattgtcatcaatgttccgggtccagacagtggatttaaggatgattccgtcgtctcccagctcctttaccgccacattgaccttatttccctctgaggggtccgggcgtatgtccaccaccagcggataggaggcgattgtctccctcatcacttcgatggcctgttccaggttgctttcatagctgacggagacctccatataattgccaatatagtcattgttgtagttgctgttttccacaattgccttattaatgacactgttgggaataatcatgcggctgttgtgataggtcctgattacagtatgacgcaccgtcatatcctccactattccggagatacccagactgcttatattcaccttctcgcccagattaaaggggcgggaccagctgagcatgactccgcttataacatctgccagaacctgctgggccgcaaaacccacaatggcaactaacagcgaggaactggtaagcagggtagcgctcagcgcctttgtggtattgaaaaggccgctgatgcagataaaggcaatgattgtcagtatgacctttgacatgctcctgagaaacttgatgtgaatctgttccttccgcttcaatatcatcccgaatatctgattgagtgcgaacattcccccactccagaatacaacaatcaccgctatcttaatcaataaaatctgcattcaaatatgtcctttcatattatgtctcttatgtgccatggccgcattagtagtctaccatacggacctgattcttgcaatctccagattctgtccattattgcagcgccataccgtgccttccatgcttaagctcttcaatctcatccgtaaatcctttattcctcataataattagaattccctgagcaccagctctgtaatcccctggttgctacccatctcgattcgtttcaccgccggctccctgccgtatccgtactcctcccggagcatgctgcgaatccgcgtaccgccgttatatccatgaatgacacgaagccggtagatacttttaccggcagtatgtatctggatgtcaattgcctttttcgcttcctctatgtttttcccatgtacatctatctctataattccgcctgtcatctgtccatcatccctcgcttcttctgtcgcgttacggggcatatcctgtgagtcctgcatcttgtgagtcctctgtcctgtgagtcctgcatcctataagtcctgcatcctataagtcctgtatcacattaagcttatattttatcacacaaataatctctgtcatgaatcacgacacaaactttaaatcaaacagaatatccccggctaactcctgaggtactgtatccgcttcctctgccaacacctgtttaataaaagcagcctgtttcctgtccacccttgcgtaaagacttctgaaccgcagcgcccccagcagcttatccctgtattcttccagtgaggcatccttcagcagataaatcagatagggcaggcggtcccaggagttctcctgcaggagaaggagtatcaggtatcttctgacatgaaatatggtatacggacctgttgcgtctgcgctctgtgctccggctgccgccgctgttccctttgattccctccatttatcctgttcctcataaagcattccggcgccgggatgaaccccatttttccggagacacatgtaagctgccttggatacgcagggcctggtgtcaagaagatacttccagtatatcccttccccttccgcccccagcagcatacctaaggattccagggcgcttctaaccactttttctgattcatgctccaaaaaaggaaggacaaggccagtcacctcctggtcccctccctgttccccgatacctaaaatggctgttaccaggtctggtcccttcagatggtccttataaaatgccagtatatccatccggctgtgcttcctcattatgtaggccgccaggtcccgtataccgtgattggcgtccagcagcaaattctccgcccccggccaggcgcatccgattacatggtacttatactccaatgcctttctcctgatacaggaactgcggtgcaccaagtaacggtcaatcatttccatagggcattggtaatgagtcagcagaccggtccatatgatggactggcagaagctgtgtctttcccggtcaagaaggttttcagcggtttccaggtccagtcgtctgcccccaaacaggaaacggtatacactctttctcatgtcataatccatgcccagaatggatggcactgacagggctcccgcctctgcatccagccgttccccaatggatttccctatgcgctccacagtccggtggtcctttctcccggagcaccttaccttatctaacgccgtcatggccatgaacacttcattcagcgaacacatttccaggcggtctgatactgcccgggcagcagccagacgcacctgttccacccagtcgttaaggcgcagtaccaggaaaggaagggctccaggataatccgtcatttcctccaggcagacctggcggtaatatccgttgggatggaagctgcccagggccaatacccagtaataatcctcttttgactggaaccagtcccttttttctcttatatccaggcttctccagtcaatttcccattccagagaagtatactgccggaatttctcactgagctgtatcacctgtctcatagtcataggctccataaccaaccgtatagcccttccaccgcgccgtatcagctcccggtcctttgacgccattgcacaatacgcctgggaaaggctggacatatccgttttttccagtctggatatggcttgggacagtctggcataataccctcgttccaaccgctccttcccgcatttttcccaaaacattaggaaacctcccttctgaccattaccttccggtacattggcttctgtctacagaatccccacctccagagctgtttccagccattccatacaggcccggtgccattcctcccaggcctgtttcagacactggcattggtcttcatattcatccatctgcgcccatactccgccattccagtattctccggaatcctgccacatggaccgcagttccttcacctgtcccgccaaatattccactgcctttccggcaggctccaggcgctgggcggccagacccattttccactccctgtatgcatcttcctccggtatttcccttaaccggtggcgttctgcttttggcacggcgcggatgcctgctatcagggcctgttcctcggcccttatctgcgctgccatggaaccgccctgttcctccctggacttccgctccagatagtgctcatatccaaaaggataatacattacggactggttttcaaatatcatcactgcatctgcaacctgctgtataaagtacctgtcgtgcgatacaaataaaacagttcccttataagcccggaatgcggattccagtgtctcctttgcctgaatatccatatggttggtaggctcgtccagaaccaggaaattaggccggctctgcaaaagttcagccagcacaagccttgccttttcaccgccggaaagagagctgaccctcttctgggcgtctcttcccccaaacagataagctccaagaatgctcctggcctccttctcagtcaaagagggaaactgggctgaaaaatgctccagcactgtctgctccgaccggatagctccgctgtgctggtcaaaatatccaatggtggtctggtttccaagggaataaattccttccagcgctggcaggaaacctgctatggtttttaaaaatgtagtttttcctgctccattaggtcccaaaagtgcaatcttctgtccgcgccgtatgcgcattgtaatttcaagcagcggtttctcatagccgattttcaggtgttcggatgtgaacacccacttgctgccaggtatcagaggattaatctcacctgtaaaaatatgaacatcatcctcctgaggtttttccacccgttccatatgttccatggtcttccgctttgccctggcaaatgcagctttgtttggtttgtgtttaaagcgttccaccagatgttccagacggtccagctcctcctgctggcgttcatacgcctttttttgaatccgaatctgtttcagcttttcttcccggtaatgggtataattgcccggatagcgcctcagtgattttccggacagctcatagacaacatccgcaacctggtccaggaaaaaacggtcatgggataccattaccactgcctttgggtaatgcttcatatactgttccagccatccggctgtctctatatccagatggttggtaggctcatccagcagcaatatatccggcttttgaagaagcagacggattaaggctatcttggtctgttctccgcctgaaaaccggctaacgggctttttcttatcttcctttggaaatccgaaaccggtaaaaagggtatcgtactcacgctcgtattcaaaccgttcccgctcaaaggtgtcccggcagggacaggcctccagaagctcctcctccacggtcctgtttccgtccttaaacgcctgctgggacagcattcccacagtgagctggcgggaacaccggattcccggtccccggcgtctgtcatcccggtccagggaaagttcccctgacacaagctttaacagggtggtctttccagctccgtttcttcccaccactgctatcttttcattgccgtgtatctcaaaatcaatgtgggagagaatcaccccgccgcccactgatacggttccgtttgaaatttggtataacatgactgtatcctctatctgtaatattcttattttgctatctgtattatatcatgccgcgcctggatatagtataacatacttaagattgtaattccttcccaattattttatactataagcagcttgtatgaaaaggagaactgatatggaacaggtcagacgcggctatgtgccggaagatgaagcattcttttacagggaggacagtctgggcaggctgcgtcttgcccaggcagacctgctctacctgattgagcggggctatcccataaaaaacgcctctgtatttacaggaaatcactatctgctctccgaacggcagcgcctggcgctggtgcgtgcaacctcctcccgtcaggcagtggccgcacgcaggagcagggaaatctcaagtcctgttacgggaaaggaagttcacatagacggcttcaatattatcatcaccctggaaatcgccctttcaggctccacccttctcaaatgcatggatggcacaatccgggatttggccggacttcggggaatataccgaatcattgacaaaacccatgaagccattggtcttttgatgtgccggctgaaggagctggaggcaaaaaaggctttcttctacctggacagccccgtgtccaactcaggccggctgaaaagcctgatactggacactgcggcggaaaacagcctggattgccaggtacacctggttcccaatgccgatgcagtcctaaaggaacaggagtatgtcatcaccagtgatgccattattctggaccactgcaaaacctggacgaatcccctccccggccttttatcatcttctcttcccggactgcgttatgtggatttgagcatgcagggcacaggggccaattgggattgtgattcccggcagaaggagcaatgataataccataggcaggcatgacaatatatttggtatacactgaaaccaatttccttctctctttcagctgtgatgatatgtccattcaaaaaagagaggtcagataaaccatccatccctctctctgtccgtcctgccagccggttatttctttttatccctgtcattaaaggatttaagcaccatctgcgccggataacaataggcataaatacagcttttcataagctcctgctcctgctggttcttacatacgctgagaatcatctctttctcatctgcctggaggtatgcctctccgctgttgcctcccatttcccggatttccttataaatacggtatttcttgtagtaatccaggccgttgaaatactttgccttcactggctccggtacaatgttcagtttataccgttctgacatccttgccagtatgttatgtatcttctcacagttttccctggtgttgttcaaatcaggcatgcaatacaaatagtccatatggaaccccttcttctgtaaacaaattctgatgatattatgacagatttttcctttgtatgcaaggagttttttaaagccacatcaatgaggcattaaaaactgcattgaacaggtttcagcacagagtctggccgcaataatatccgccagtcccattcctcctctgactgcgttcccagcccctcttcttttgttattattgtaaaatcatggtattatggagtattaatagtatccggtggtcttgacttaatactgaagtatattttctcaaatgttttgattttgtggaagggtactggctatggagcgtttacgatttgacggtaaacgtcaaaccatccgccccagcttaaactaacgccgcttttcagcggcgtgcccatcgttttttcattgtcacaggccgcccggatcattttggacagcagcatcaaatcgtcgatgtattgggagtacacgcagaacacatcctcgtcagagtcgaagtgaaacagatccacgccgctgttattttcctcgaactcctggatcacgccccggaccagccgctcccagtctccgctgcttccagtcagtcccagccgacggaatacttccgtccggaatccattgttgattttcagcagaagggagagcgcataggggtggtggggaatgagaaagaatggcgcaatctgctccggcttcacccagattttgaagggcggacgcgggtcaggtatccagggcaagatttcccattcgtcctccggccggtttccgtattggcaaaggtctttcatagtgttctcctttgttctgtcacatttttaatcctgctctcgataactggcttcaatgtcaatgaaccgcacatacacggcgcagattttgcccttggcgtcatacccgaagtagacaggatagtaaccatccccccagccggaggcaaagatgggcaggttgcagtccgtgcccggcactgtccagttgagccagtcgccgcagtccccctgatatttggggtaggctttggcgttttcttccagaagatcgcagaacaggtcgttgtaggggtcgatgtccgggtcttcttctaaacgcttggcccagtatgccttgaaggccgcctgggtctggatgtccgcgacacagcccatcccggcgtctacgccaaagccaaaatactcgtcctctcccagttcctcgtccagatcctcgttgcccaccatgcccagctcatagcggacaggcttttcctgagaaacctccaccttgacgcaggcatagcggtcgccgtattgttcgctgggcaccacgcagatttttacgggataagttccggcggggatcgtttgaaggaacggcagagtgtcctccagttccaccagcggatcacaggcgaaaatctgcccggtggggaaatggacggtgccgatgtccagcacatccaccgccatgttcccaatcactttctctgtgaaatgggcctccaagtcatctttacaggtcaatttatccttgattgcttcgtatttgttcagccattcagttgtaggcatatcagtttcctcctgttgattctgtttcttgatgtacacactctttgagccgtcccaatagcagttcacacaccggccatcctgaaaatgatggtcacaattcgggtagccatagagaacatgggcacattctggcacagccccatcatctgtgaggagcctttgaaaaacaggcttccgcactcatcacaaagggccagttctttttctgccatagggttcaccagtcccgttcccggatggcctcctcggtgtcaatggggatgccaaaacactccagaatgtaggccacggttgccgcaatacattcccgcgccaccgtttcgatctcgctgtcgttctcgtcaaactcctcctggagatcattgatgccgcagaccgcctcgtccagcgtttcctgcaccacttcggtgtcggtttcgccgctctccaacaggtcaatgaccttctgaagctcgtcttttaccttgtccaccagaaaagtgggatagtaattgtcctgatacatctcgtccagcagtttgtaattggggtcaaatgttttcatagggattgctcctttcttcgtgctcggcagtcatgctcaactcgatctcatcgtcgctgtaaattaagtagagcccatgaggggccttgctatcgaaatgcagttcaatttcatgatatttgaggatcaaaggcttcccatcacttctcatggtggaaacagcatcgggcttaccgaagatttctatgacctcatcctgtgacataccaaatttcagcggtgaaatgttctggggattctgcaatatttgattgcgccaaatcgtaaagtcctgtttcatagttttccgtccagtgcctcaaccgttttcatggcagcggaatcaaatttgcactgccgcagttcccgttcgatcagggcaaacacatccggaaagcactcaatctcatcctggtactcatatttcgcatacaatttcccgtactcggagatccagacctccgccgggtagtagtagccaatatgaccgataggctggcatttttcaccggcagcctgttcgatctctgccagttcacagccggacatatcccggaaataggcgtcctccaaatggtttttgatcccattgaccaggtaagggaataaagcaaactcaaagtcagctgcccatttcagctttttctgtgccaagtaccactcgcagcacaggccgaaatatttgcgataaaaccgctgggtggtcttcatcatcgggacgccatgatcggcgtaatactgctccgcaatggagatgtccacactgcggccttcgtaccacccggcgtactccatcagctgcttaaccttgctgcccagatcgccagagatagggatgcgttctttgatcatggtagtatcctcctgtttttcgtcaccacagccgatcgatctgggtatatatcttattcggttctctgtccgtaaaactggtcaatgcgtcggtgggttctgcaagcggcatcacattcaaaatatccagtacataataccagaccccagtgtcccagtctcggaaccgcccattgcagacagctcgaccataatcaccaggaatcaaatccagtgccagctcattgagaggctgtttctgcccggtcttatcgtaggtatatcgctccggtatcgccccgatgtgccaatcattgcggtaacgcacatggattccgggctcctgctgaatcagttcgaaagggtgaagccgcattgtgccattcggcttccattccatcagcctacgacagtccctatcgatctgaaatccatcgggcctctgtatgatagatgcaaagtgagtaggcagaccaaaaggataataggagaagaagtctttcggcagacgcatggctctgggatactggttccgctgtgcggccgcatttccgccccggcagtctttataccattgcaggcggatctgctgaaccagaagtgtgggcagatgctccaactgatgcttattctgtttcatcgccatacctccttccttgatagatccctccaatggtcttccatgtttcaggcatttacaactctgctgcaaactcataggaaaccgcaatgatgttgtaaacatcatcgtatgtaaacagccggtagtgccgatagatgcctttgtcaaagtcctcccgcactggcagagacttcagccaggtgctgtcctcaattaaatcgaaggaactgccatccagatactccgtcccagccatattttcataggtgtccaattcacaggtaaaataggccagcacctgccggaaggtgagtgtatagggaaaccagtctttttcgtccctgcactgggagattagatggccattgatgtcccccgtaaaggtcagattgttcagagcatcctgtttcacctgatccagatagatgcagtcccgtcccttcaaaacacctaagcaggtattaacagcagtcgctttttccatagacaactcctatccctcaatgttggcagttttgaggccctttttcaaggagccgtagatcgtcaccgcatggtcggtgaacatctcgtcgcagtcaaaccaggcggtgaagctgccaccggaggtgacggacaggctcgtcaggctgatccgtcgggccaattcttcctctgtgatggggtcggtttccggattgcgggggggttcctcatcctgggagagccagttgttggccagctcggtcaggttcttggccgcaagctctcgcatggccttgtcccaagtttcacagtcggccagcaacttcttggcggcactgcgggcgcgggtccaggagggcttgctctccgcattgacctcaagggaaagaagcacatcctttccgcgccactggatctcaccctcaaaggcatcatggtccttgtccagctcgagctttcccagcacctggtcctggatcaccaccggcttgtggcactcgtccagaacggcctgaagttccgggcagtcctcatgggtcttgaccacctcggagatacaccagggccacgccaccagatcctttgcccattcttctttcatccggcggattttcaggcggcagatctgctcgttttgaaagcgtccccagcccttttcactgttgcgctcctcgtcggtgactggccactccagccgctcctctttggtggtgaccttgccggtgtcacagaacaccatgcccagcgtcacaacagtcatttgccaaaagttgcccctgttgttatatccgcccccgatgcagcgattgatcaaagcgaccacttcctgctcctcggactcgtacatctcataaaattcttcaaacatagatcattctccttattcctcaaactcgccctcaatcatcccgttcagataccggccgggatctgcgatgaagtcatcccatttggccagagagtggaattcctcatgctcgatgtccagataccacagctttttgtccctggggctccacagcagcaggtagtcgctgtaattgtccatggccgccatgagggagagcagcttcttccgtttccaggtcatctcctgcacatccatgtaggcgtacagctccgcccatttcacccattcctgctccgggaattccaaacgcagggggccggttttcaagtattccaccagcttggcaggcagcttgtagggcataagctgccggaccttttcttgttcgttgtgccagtcctccggctccagcgccttcaggtagtcggccatctcttgattcttgttttgaactgccacactgtaaggccggtcgccgtatttgttaacaagggtgatattcgctccctgttccaccagccagcgcaccatggagaaattgttggagcgggcggcctcggtgacaggggtggaggcgtaagggaacaccatgtccggcttgtggtaattgatgtctgcccctttttccagaagcagtcgggcaagtttggcattgccctcggacacagcggcccggaatgcctcgccgccaaacttatccactgtgatcccagcctgctccagcaccgggatattctccgggcgcttgccccagcgtacttcctgaaaggcccgctctttctgcttcaggctgagttttgcagcctgtccagcaaagagcgccaccacctccggcccacaacagcgggcagcggtaagcagcaggggctgttcctctgccagaccgggatcagctccatgccccagtaggaagtgaatcatgggcacatcattcctaaaaaccgcgatctccagtggtgtgagtttgatatactcgctgagctgaatggggtcatctaaatccagaccgccctggagcagtacctccagcttggaagtgtcatagtcacaaatggcggcagccgtttccgggagggtctcccagcggccaatatatgcaatttggtacataaggcacctactttcgttgttgtttcactttatagggaacggttcggcccagcacccggcccttgccaacggcattggctccctcatagatcaaaaattccgcattgttttccagcggggcatagtcaatggtatctggatataggggttgggcatttcccaaagctggtgtatcaaatgtacactcggttccgtccagaaagcatacacccaaatattctgtagttcctgtgaccacaaaatggggacaatactttccgctgaccaggctgggtggtatttttcgtttgccgctccagaagatgacctccacatggagcaccgcccggttttcatctgtcccgatcacgctgtcgccctcctttatcccgtcatctggctgcggtatactcaggccagctctgcgtccaggatctggactggttttcctttctcgttcacatagtaaagggcgatatagtcgatgccgtcccgcttggcctgctcccacggcatccgttcaccgttgatcagttccacggtatccgcctcatccggttcaaagttctctttttcgtcctcatagtcaatgctgtaccccagctccagcaccaacttggaggcggggatctcataccgcttgagggggcggtgctccagctcggatggatcatgttcatcgcagaacatattgtcgtagccatgccgtccaccgtcaaagatgacgaactcctcgccgctctccgggtcacgggctgtcaccagtccgggggcctcgtcgctatctatgatataggattggggttctcctttcaccgtgagcagatctccgtaataccaaacctccagcagttcattgccggtggtggaacaaagtatcacggtgggcaaacgcttctccgcccattctttcacatggccgatgagccaggtgggatatttctcagtcatcatagtctttctcctcctatttcaatttcagcacaaatccccagatactcaccacaatcaagaggacacccagcagaaagaaaaccacacgccggtatcctctgctgtgtcgatgggcatcccgcgtaccagtggggtcgcagagccagttccagttgcggatcgctccaaacaaaatcacggccccgatgagcaccgaggcaatgtaccaatgctcttgtaaaaatgctgtgatctgttcgctgttcattctacttcctcctcacgcaaatacctgctggtatttctcttttcatactcttttcaaacaataaaaaagccccacgccgcactgtcataaagacaggctgacgcagggcatgaagaagccgcgttgaaggagccgcatccaccagcagatgtagtttcttcaacaaccaaaatatttttttcgtatcttaaagcagcaaattgctgtccaatatatttgttcatagcggcaccatttgttctgagcgtagttttatatcttattatatcacagcaccccttcaatgaaaatattttgttggaaatgctaatgaaaaatttttgtgaatttgttaaggcgcaggggctgttatctccatagtgtctggatggatcagagtgattacttttccctgatgcaaggcatagttgactgtctgtgctgtacctgagcgcagctttttctgattatcaaacacaccgatgatgtactctgcatgatcgaccatatagtaattccttttttttataactggaaacatccgcagaatgtgaaataacaatagaatcgtttgcgttttggatcagctttttcaatctatgtttactctgatccggccatttagagtcatagccgataaagggaactacaacgataattttaatatcctcgtatcccgtttgtgctctcaatgtcagcagctgttctccagcccacatatccacaccaagagcaccgccgacaaaaaaagtacggacaaatttctcgtcatggagtatccgaaactgctccaggagacattcttttagtttttggcataggggatcttcctcattatatccaaagcaaaatcttgttggtctgtggccggtaatggcgcaggcatactgattcatataaatcacccttgataactgccgtgattacgcatataaagcaaaaataacgcaaataataatgcgtataaaggtcatattacaaaattataacacaacacatacgaagtatcaagaattgctttctgctatgctaaaagagcagagaggtgagcgtatggacgaagaatttatccgcaatcgaatcacagaattacgattgaaaaaaggcgtttcagaatatcagatgagcatggagttagggcagaacagaagctatattcaggcgatttcttctgggcgttctatgccgtctatgaagcagtttctcaacatctgtgagtattttgaaatcacgccgcttcaattttttgatgcacaggaaaataaccctcagcttatcaagaaggctttagacggaatgagaaagatgtcagatgacgatctgattatgctgattggttttataagtcgcttaaacacagaaaactaacgataggaggcagtaaatgtcccgtcgttagttttttattttatgcgcagcatattgtggcaagcaatgcttgtggctatccatttcgccacaaactgcttgttgagggcagtgcccccaagcccctttgaacacagaatttcattctgtggctgcgcgttctgcgaacgcttttgaccaggaccagcttatcgctggccgtggtctttttctttttcaacatcctgttctacctccattttcagcacccgatccacattggcctttgcagttaaaagctcccgcatttcctcacgggaacgccggtactcggcataggtctttttcttttcttccagcaatttcgcatactctgtctgcaactctttgaccttgggcagcttcttgacgcccatctcatcaaaggcattcttagcagcctggtggagcagaatttcttcctcatgttcctcccggaatttcttagagtagcctgccttgcggtatgccacatagacctcacgggtcttggcataatttacaatgtgagtacgcagaacagcaatctctgccatgcgcttttcagccgctttgatctgcgccgaaagctcattgtgatgtgccgtggcagccgcagccttttcttccaaaaccgcatactccagcaggttattctctgacaagtaattcatggtctgcgccatctgcttgaggttgaacaccttggcccatcgagcatagccagcaccttttccagcctgcaattttgcctgaatgtccaccagcagattgaccttctgcgtctctgcctgtgtaactattttctttcgtggggtatgcgctttcttcccggagagaaccgcctgcaaatcatctaatccatatccttcgcccaggctgtccattcgggcggctttctcacagccggggagtttcaaacgatacgattttccgcgctttgatacttcacagccggactcttttagcagcttcagcagttcctcaaaattagcaggactttgtgataatgcgttgtcaatcgctacacgcagcagctctcggtgagagggctttgcctgatcgcccagccacttgttatagctctttccgtgaggtttcggattctccacaatggacagtccgttttcgacgcagatggtgtcacttaactgtcggactgccttggtgctgccccaaaagtttcggaatttccggtcatattctaagctgaccgatgaccagataatgtgattgtgaatgtgcgacttgtctatgtgggtgcagaccacaaaggcatgattgcccttggtgaatcgcttggcaaattccacacccagccgattggcttcctccggtgtgatctcaccggggcggaacgactggcgcacatgataggcgatcacatcatccgcacctcgcactcgtccggtcgcggcaaggtactgccgctttgccagaaggaactctgcatccgcagtcctgctgtcacacgcatagccggtaatgagcctgccattatctgtttttttgggattggccacatagtcgatgatgtcactgatcgcccgactttctgtgcggcccttgccgacatgaagcggcatgattcttgtggttgccataggtcagacctccttcccgaaaagaaaacggcctgccatagcagaccgctttcactattctataaaactttcttcatcgaaaaaattgaactcatcatcttctaagtgtcttggtggaaatctcatttcatattgctcttgcgccaatgcacggacatcaggccgcctatcctttagtcgatttttcagccaggacaactgctctttcgatagcctccatggaagattcaaaagacgattcagtgtcatcagttcagcctgcttttctgctggtagcgaagcacaggatttacaaatgtgggatgcatgacctttgcctgaaaatttttcgttggctttgtattcaccacaaactttacaatagtgtccatgctttttcataagctgatgcccttctcgcaaagaacatataacctgcgaattgctttcataatcacatcccattccaaatcagaagcataagaaaactttttacggtatgcctcccaaagtttttgcataaccgaatcattttccacttcgtcaaaaacttcttcagcctggttaagatacttctccgatccccgtttatgagcagttgccagaagcgcatcatgtaaaattttcgggttcagcgtggttccatgcagctgttctaaaatgtaaatatcgtagaaatctctcatgcgggtattggttgtggttctagtaataatggtttccagtttttctgccagcacagtttctaaattataagcccaaatatcaatggagcgatcttccagcataagtttgaatgaataccgaacctctcttggagtgattgcatctcccgtagaaatatcaattttcaaaggggtcactacaccatcgaatgttgtactcatgctgacacgaatccccggatactctgcttcatccataatctccgaaatacttttcagctgaaatttaacaccatcatcaatcggaacagttacgattgatgaaattagattctcaatatcctccacattaacattagctccttttatggttgcatccaaatccatcgtagagcgggcatccaatccaaccatagccgctaccaacataccaccctttaagataaacttatcacgatactcagaaagagaaatacgctccaaaaaacgctccatcatgtagttcctcattaaaatctgagcatctgcggatttttctctggaaaggtttcgtattaaatctttaagctgccttgctgtttttatcataaaagtacctccaaatactgtcgtaaaattttttccaccttgaacatcccagcatattgcattaaagctcgcaggttcttatcttttctacgggcatacgctttcagtgctccctgaaaggtctgaatttcaattctgctacggcttctgagcaaatcacagatcgttcgctccatatcataaaccggcacagtatgcccgaacggagttttcgctgttgtaagtcctacatcatgtaagtctgctttaatcgtaaaaacttgaatgccttctgctttcattttgcttggattgcatccagttttgaccgtaactgtatattctattggttcacggtctgtcagatcgtgaaaaaataaagctgtttcatgtgaaaatactgcttgttcaaatcgcaaatgaagcagatacatggcatccacccaggaatctttggacagataaatcccatgtgcgactctatccaaatctcgtgaacgcacataatcataaaataccggctttgaaattccagaagatacgacctgcgatgttcgcagcattccttcttgtgctgttagcatctgatccagctgttcaaattgtcccatcatgtcacttcctttcgtactaatattatattcaatattagttcaaaagtaaagtcgtggatataaaattccttttcccaaatttaacagacggtgtctggcatttttatggttttgcgtatttttatccataaaccaactcctgaattgcaaatttcaaactctgcaccttgcccagtagccagattgcagccagtggcagccccatcgggctaatcaaaaatgccataaccagcaaaatcacaccattctgcggggaataggtaataagcacagccacgccaagcagagcaattacagtgctgagcagaccaagcaccagaccggatatgtagatcagccccgtgcagagccagacaaaaagcgtcagcaccaaaatgaccggtgcagttataatcatcaaaagccctttcaaaatcttcatgttatttcctccttgcagcgttcttggtatcttttctaatcatattatccggcatgggcaggcaaaagacaaggataccgataaaaagaaaaagcggagagaggagcagcgaagtaatgccgttcctccctccgcaaatggagtatctatccctgttataaaagtttggaaagctgggtaagaatttcctctacgccctcccataactgttcctgccgctgggatatatcctccaagtcagcatcataaacccgtccagtctcatgcactttacgggtcagctggtttaagttgttgctgcttcggcgcatcagggaaacaagctccttcaactccggcagctccagcttgactacatacccatccagcgccatttttcttagataggcttcacggttggaggttccaaactgagacattttttgctcaatcacagcaagctcctccgctgaaactctaaagtttaattgcatatcccgcttacgctttgccatagttatcgctccggctcccgtttcttcggggcggcaggcttatgggcaggcagctcctgtttgagcttatcccgtactgaggggcgggacggttgcagtttttctccctgagtacggctgcgctgctgttctacacgcaccagatcaataaagccatccagcacagcagggtggctgtttaaggcataaccacaacggacagtttcgggattatcgttgggaatggtcttagcccattctttgttgcgtcgggagtagcgcccatcccagtcctgaagctggaccgtgttagacagaaccatggacacacgctccatgccatagatctcgatcacaccatttgccgcatcgtggctgagatacattccgtcgaagtgttcccgcaccgccgcttcaatggactccttgcattggagatttgcattgttggaagcccggtactgctccagctccccatgttctctcgcataggcggcagaatggggatagaccggtgttgttcgcagttcctctttggctctgcacacatcatcggcacggttctcaatgctgtcccggatcacatccatgtgaccggtctccagcttttcaaagtaacggtacacatccgccagcggagagggagattccaaaagtgcctgagcctgggcatcagtcagctccagttcctccatcgccatcacaatgtcctcacgaaccgtgtactcataggtgtggtgcaggatttcttccgggggctgtcttttcagccagtcccggaacttgtcctgttcggcagccatcttttcataaagggctgtattcagatcgttagtattcatgttatcgcacctcctcatgctgttttggtttcttgtctgtactgcggggttgcaccgggcgttttaggttatccagcaccgaaggccgtgtacttttggcaacaacagactcggtgtgtgcctgtccctttccgtcgatgttgagcagggtatccagctccaccagacgggcgtttttgcatctcagttcttcttcataaaggaatggctttccgacttcctcctttgccgcagcttgctgctgacagaggttatccagctgtgcctttgccgactccagacgctggggcatctgagcaagggcattgtcgatacgggtaagatttccgcgagggtctgtaccaagggttgcccggtgggtcatctgtcctttcagcaggagcgtatactcctgtttccaagcggaaaattccacggacatggcatacccccggtagttgccgatctgcaccggatcggaggttttaacctccttgcaggcatccaaaagggctgcgccggcgttctccttatcggtcagcagatcgccacggatttccataccagcaaaaccgtcctccgggtgcgggtgcgctaccaaaacctccagatcggattcaaagcccttgataaagcccttgtgcttttcaatctcctccgggaagtatttgagcagctggtcctccagacgatattgcttgctctggtggtcggctttcatcagcttcaggcgggatacctccacatccaaatccatacgctctttgatacgtgggtctccggcacacaaagccttgatctctgcaaaactgagggcggtttcatccacatcatcgcaggagcgtaccggcgatttagaagtcatgatctgactaatgaatttttgcttattctccaccgtctgccagaggtatgcgtcaaaggttccttcggtcacatagcggtacacatggacaagaggattctggttaccctggcgctcgatacggcccttgcgctgggcaaggtctcccggtctccacggacagtccaggtcatgaagtgccaccagacggtcctgcacattggtgcctgcgcccatcttggcggtgctgcccaaaaggacacgaacctgaccggtacggactttagagaacagctcctttttccgcacttcggtattggcttcatggataaaagcgatctggtcggcaggcatcccctgagcaatgagtttctgacgaatatcgtcatataccgtaaaggtcggttcctgttccggcagaggcacagcgtcttccaatgcgtgaagcagtggattatccagcgttttcgccgccttgcttgcaggagctttggcctgtggtgtagaaatgtcgcagaacaccagctgggtcagcttgtcagctttgccgtcccgccagatctgcatgatgttgtccacacactgattgacctttgtgcaaggttcgtccggcagcatctggttgacgatcctctggtccagccccagcttgcggccatccgaggtaatcttgagcatgttatcctgggacgggtcaacagttccgctgtgtaccagcgatgcacgctccgaaagagctttgaccatttcctgctgatgttcggtaggctgcgccacgatgttgtggtattccacttccggggtaggcagattcagctggtcggcagtcttaatgtcagccacttctttgaacaggttcatcagctccggcaggttaaagaacttgctgaatctcgttcttgcccggtagccggtgccttccggggccagctccaatgctgtgacggtctccccaaatcgggaagcccaacagtcgaagtgggtcatgttcagctcttgcaggcgttcatactgaagataacgctgcatggtgtaaagctcggtcatggagttgctgaccggggtgccggtggcaaagatcacaccacgatttccggtgatctcgtccatatagcggcacttggcaaacatatcggaggatttctgcgcgtccgatgtggaaagaccagccacatttcgcatttttgtgtataaaaacaggttcttgtagttgtgggcctcgtccacaaacaaacggtctacccccagctgctcaaaagttaccacatcgtcttttcgcccctcggcttgcagcttttccagtctggcttccagagactttctggtacgctccagctgcttgacggtaaaacgctcgccgccgctggcctgcacctctgcgatgccctcggtgatctcgtcgatctgctcatagagaagccgttcctgacgctcccggctgatggggatacgctcaaactggctgtgtcccatgatgatggcgtcgtagtcaccggtcgcaatacgggcgcagaacttcttgcggttatgggtctcaaagtcctttttggtggtgactaagatgttggcagaaggatagagacgcagaaactccgacgcccactgctctgtcagatggtttggaaccacaaagagagatttctggcacagtcccaggcgtttggcttccatcgaagcagctaccatttcaaaagttttgcctgcgcctacttcatgtgccaacagggtatttcctccatacagcacatgggcaatggcgcttttctggtgttcccgcagggtaatggccgggttcatgcctccaaaagtgatgtgactgccatcatattcacggggacgggtagagttcatttcctcgttgtactggctcaccaaagtctggcggcgctccgggtctctccagatccagtccctaaaggcttcccggatcgcctgctgtttttgagccgccagggtggtctccttggcattcagcacgcggcgctcttttccgtctgcgtcctctatggtgtcatagatgcggacatcccgcaggtttaaggaatcctccagaatcttgtaggcgttggcgcggctggtcccataggtggtataagctgccacatcgttgtaggatacagaagattttcccttgatctgccattcagcggtaaaggacgaatagttgacctcgatactgcgttggagataaaacggggtattaaaggtctcatacataaactgctggatatattccttgtcaatccaggtagcgcccagacgcacctcgatctccgacgcatccaggtctttgggctgggcggcggtaagagcttccacattgactgcataaaccgggtcctgctgtgctgcccgctgtgcctgacgcagctttcggcgtacattgccagagaggtattcatcagcagtcacataatggggcgttctgtcctgctccaactgtcccggtacacggaagattacgccttgcagctctccggccagttcttcttttgtttttccggtaagctggctcatatagtccatatccacgcaggctttttccgagatggacaccgccagtgcttcacttgccgtatccaccacagccaccgcctgatggggcttgatggtacgcttggtgaacatatctgccttacgttccagtttaccgtcctcgtcgatgacttccagcgcacagagcaggtaataggaagaatcgtctgcataggccagacggtttgcacggtcattgatgagaccgtatttggcagaaaagctgtcatagaggctgttcagttccgcctgcttctcccgaatggtgctgtccggaaccgctgcatccatctgaaggtcgatcagttcctgcacacaatcacgcagtcccacaagaccttttacacgggcttcggcggtggcgttgaggtcagggcgcaccatacggctgttttcccggtagtacacctgcccgtctacaatggcataggaatagttcttcacatttgggtcggcaggaatggaggtgtcaatggcttcgccttcgcccagctccggcagctctgcctcctgataagtgccatgaatatacttcaccgcatcatgcagctggtcggaaagctccagtccctcgatagggttcacggtgtagtccataccatgagcagtgcttaccggctcctgtctgcccagcaccatttccggatggtcgataaaataccggttgatggcaaacccatcctgcgtcgtcgcggactgcgcctgctcgtttccgccttgcggcgaaaagctcgcttgctccgtcgctcctccttctcccacaaagtcttgcgactttgcgggaaccctgataatgccggtctgcgtccactctggtgcaatgtccagcgggcggtcccgcttttggaggaagatgatgtccgataccacctcggcaccggcattctttttgaacgcgtcattgggcagacggatagctcccagcagctcggcacgctgggcaagatagcggcgcacggtggaatccttggcgtccatggtatagcgggaggttacaaaagccaccacaccaccgggacgcacctggtccagtgatttggcgaaaaagtagttgtgaatactaaaattcagcttgttgtaggctttgtcattgacctgatactgaccgaaaggcacattgccgatggcaaggtcaaagaagtcacgcctgtcggtggtctcaaagccgcctactgtgatgtccgccttgggatagagctgctttgcgatgcgcccggaaaccgggtccagctccacaccgtacagacgactgtttcgcatttcctccggcagcataccgaagaaattgcccacacccatagatggctccagaatatttccggtctcaaatcccatacggcccaccgcttcatagatggcctgaatgaccgtagggctggtgtaatgggcgttgagggtggagcttctggcggcggcatattcctccggggtcagcagctctttcagctgggcatactcggaagcccatgccggtttctccgggtcaaaggcatcagaaagaccgccccagcccacatagcgggataggacttcctgttgttccgggcttgcctgctgtccggcagcttccagctctttcagcaaacgaatggcattgatatttgcctggaacttggctttcggaccgccttcgcccaaatgctcatcggtaatacggaagttttgtgcattgcggcgcaggttggccttgtattcctcataggaggcttcctcggcagctttggcattggggaaggtctgccactggccattgacctgaatggaaaccgggtgttcgtccagcacttcctcaaagagtttctccgactcagtcacaggggctggtggctccggctcctcgatatgcagccgttccaccaccacatcataaggcagattgttcttatcgcccggatagacggccacggtctcggaatggaaggtcggggattcggtagacggttggggctgttcctgtccaaagccatccatctgacgggcatacatcccgcgcagcaaaggcgcaacttcatcccagcggaaatacagcacagccaaacgcttttcctctgcgtccaggacttccagctccatgccctgtgccgtggtacggtaatcggcaatatcgccggtctccagattcagggtctcaatctcatgagggtaggctctgctcagccagtaggcaatctcactgttgctcctgccggattgcagcagcgtggaaacctgttttttatctgcttcatccatcagtccatgggacaatacatcccgcaagtcctgatctgccttgtccgggtcaatgggaagaagctcggtatagtaagcattgcggcggtctgcccgaagcagctgctcgaactgttctttgcgctctgcccgatagatgggatataccatgccggtgggcagaagctgtacggtgtcctcccgcagctcggtgatctgataggcgtcatcctcgatatacacggtatcgcccacagcataaaccggggcggcagggtcataggaggttctttgcggaattgggcggcgaactgcgtcatattcctcatcggaaatggaaacttcggaagtctgctctgtctcggcatctgacatcacctgttggataaatggggcattgtccagtttttccgagtctgccacctggccgttgacgatgcccctttcctccagggcttcccggatggcgatggggtcgatattgtcaaaacggtcctgttcttcttcggtatagaaccggtcctcctgaatgagctgggcgattcggcgctgtaccttcggccagggcagctgcgtttcctccgggcttccggcacggacaacgaacaggctgttgctgccgccgtattcctgagccagccatgcagcggtatctttctctcttgcatgatctttcatatagcggacgacagcgtgtttactctcaatattgccgttccatgcacaaagggcagtatcaatatcttcctgagaaagagggcgcagaagctcatggagctttggataggtttcgtcgatcacttcccggtgcagacgctggcggaactccggcacatccgaatagaggcggatcagctccatatccttagaaccaaggaccgcacggcgcacagcggcattgccctcgatgacagcattttcatggtcagaatgaccgcaggcattgcggtatgcggcatcctcggaaatagcggcagtcaccacaggcttatactgctcaaactgctcccgaagggtaggctttggcgtttcttcctccacctccggctgctgggcttggatggcatcttcttctgccagttccttttcagcctggattttgtcatactgcgcctgttcctgttcggtaagatagcggcctttctggacaagagaggtaatgcgtttggcaaccttttcccagttcaagtgaacatccgggcagtcctgctttttatagtgcagtcctttcccgtcgtgatcttcgccgctgtgtgttgcgccggacagggcatgagagcgtccgccaatgccatactcgtctttaaggaatctcactttttccttatccgtatggttttccatgaagaacgcatagatacggccttttcctccggcaaaactgcttccgccggtcatggcggcgtcgatctcatcctcggtaatgaaatgctggacggttggcacttgggaaaggtccgaagaaaaagttctgcgtggcaggtcaagatccttcaggttctcccagatttcccttggcctatggtaatgaaagcgcaacaggtcacggtcctgctgataggcagtccagaaggcagcgtattcttcctttagggtttggcggaaagccgggtcactcagctgctcggcaagccatgcagtttcttccgggaacccggttctctgaataccggacagacaggacagatacccggaatctctggctttatcgctgaaatcgtggtacagatgccaaagtttttctgcaaggagggagcgttcatagcctgccgcttctgcaagctccacattggaggcaaactggccactttccaaaagttccccgatgcgctctgcggcactctcccaggaaatgacctgggcagacctgtcataacggacagacttcccgtgggaaagatggataccatcctcggcataccatgcgctcacgctgccaaggccattgccgccgtggtacagcgttttcagtatctcggcaatctcagcggtggttttctgcttttcaaaggctacaaccacacgctccctctggcggtctgtattgccgcccaaacgcagcacatggtcaatatcattttgggcaaaagaaaaagcagaggatgtatgcgctacattctctgcttcatctatggattggatctgctccgcttcggagaggaacaggtttagggtcagctgttgataagctccaccatcaggatctcctctgcctgggctttgcaggtgttcatcaggcccacccacttcatgggatcgctggctttcagttcctcggtggctcccgcttccttcgccagctggggcatcatctgttccagtctgctctgggcggtctcgtcgatctcgatgaggtgcggatacagcttctcgctcagcaacatctggttgtagaggatgggacggtgttccttcaggtaggttttcctcatcctgccgtacttgcccagggatttctccggctgctggctcagcttcaggtcgggaatctgatagtctccgttctggatgtaggtcatgggattgttcatcttgcttgctcctttcttggttggcttcgcgctctgcatttcggacggtaacgccgatctgccgcagcacctgctggttgatctggctgaccgctgttcccagcgccccgatggtggacggggtgttgaaatcaaagatcgccatgaaatcttcgtggtcgaagtagcgttccggctccagtccacagcgggacatcaaagcgtaagtgatgctgacggtggcggctgccttgaactgcactccgatgttatactcatcatattcctccaaaaaggaaccgtcaacgatatagaataagtcctgctgatgctccgtccagtattcctcggccagttttccggctacctccgtgagctgtccggcaaggtcctcaccggaaacatcataggtgcgctccagcatggcctgcacggaatccagatggcgctcctccagctgccacagccagggagtgcgggaatgttcacgggttccggtgtcggaaatgtcaaagacataacgcaggcgaggtctgtccccggaatcatccaccagagcgattcccttggaaccgcgccttacataacggcccatcttttcattccacaaatcgtactccgcacaggcggtggcgtccggtcgctgggcatagatcatcagctgctcatggaacgggtacttgtaaaggcgggaagcagtagtgagaaaccctgcccattcctgccagctccccgtgagctgtgttgccaccttgtccgccatctgtgcatatagttcagctttggttggcatagtgttctgtcctcctttcagttttggggtaaaaaggcggggtggcaatttgccaccccatccctgcggttatggtgtttactggtcaaaatccgggtacaactccagctcggcaaactcggcatcactcatggcctggagcttgcccagtgcgctgtctgtcaactcccgcagctcggtttcctccggggccagctcgccgcgcatctcacgcaggctgtcgatcagtccggtacggctgccggtattgtaaatgcacatcaggttcatttcctcaaaagtaaagtttcccatatcaaatctccctttccgcactctttttgggtgctgtctttttgtgttctgtcttgggctggcctttcagctgctccatgacggactttttcttttcccgttccttccgatgaacggcatcagccaagtccatcagggaaatgggctgaccgcttcgggcctgctgttccagctctgccaccgtaggttcttttgcgccattgttgatgataccgtcgatcatgccgtaatcgtcctccagcatcatttccgcatttttcagcgggttttctggcaggaatccgaggatctgggtaaaaccaacgctgtcacagtaatgacaggataccttaccgtcctgtctgattgcaacgatgtcgctgacgctcatggagggactgtgaaagtccacgggcttttccagattgaattgctgatagagtttttccagctgctccggcacagtgccagactccctcagaggagctgtgtaaatgaggtcataattgctgcggtctatggaaatgtcatgggactttaaccaatccagattcataaagcgcacattctgcggatcgtcacgacttacctgatagatggcaaagcaatctctgttctgggagagaaatgcctgttcgcgttcctgctgatgttcctgacgctccatgaccttttcgtggaactgagggcttttctcccattcctcatggtccacaccgaaaagaccgccatgatccatgatttcctgcgggtcaaacaccatgctctccgtattgtcctcatgcagcacatagacggtcaaaccggcggcatccagttccagcgcccgttctctggtaacagggagcatcccatcataggagtagccatattcctgcatatccggtgtggagacctgctcatccggcatggggtattcatccagtgcctgctcctgtgcctccggcaactgggaagaagcaatcatctgactggtctctgcctgcatttgctgataggccgcttcctgcaaggtctcaatcatggacataggagcgtgtctaagtgaagtgctgtccagattgttgtcatcacaaatctggagaactgcatttttgcgggaaagctccgacatatccagctgaccaccatccagctctttcatggacgcagcatcgtaaagagtgtagtcccatccgctgtcacaaggttggatatgaagataggtagtatcgttgatcagaaacaaagcctcctgctggttggcatccgcccccagtacctccatttccggcatggtcgcagccagttcctttaccgctttctgtaccagcggattgtcacggtaatagtcgattgcctgaatagtgtccaggtcaatggtctgcccggtcaaaatcggaaacggtccttcatagtcgcttccgtctttcagctcaaaaccaattcctttgatcccgttcattcgctctgccggaatttcctgatagatgcggaccgcctcctccaaagacaggttatcgtggtattctccgaggtttggaaactccatgcactctgccacatagtaagtcagattgccggttggctgctctatcggggcggtttccggctctttttttgcattggggtcaattccacgctctttgcagatttccttatagtggcgctcaatgtcagagatcaaagtgccggaggtcttgttgatggtttccaaactggctctcagctctttcagttccttgccctgactccagcttgcaatatagccgaagctgttttctccggtctcgatgccaaaatacttgcagactgcataggagatgctttcagcctccacttcctccgtgtggcggtctttcctctgttcttgcaaaaactgggcgagggtagaaaagccgccaacaaaattcagcccttcttcctcggtcagcatcaggcgtccatcttccgccagctccaacggctctgtcagcagaacggaacctgcatggtttacaaccactcgttcttctacacagacctgctctccggggtcgtagtcagaaccgcgcaggtcatagcaataaacgccctccggcagattatcacggacaatccgcccattggagaacagaccgggtttatcaaacagctcgatctcctgatattgctcgtcattggcaatctgaatctttttctgattgtggagcttgctgtgggcaatctcatgaaccgtggccgaaaccgtctgcacctcgctcatgccctggcgaatggcaattttctgatgatcggcagaaaaatagccgtccgtatcggcggccattgcttcaaaagtgatcggcaccagcgcactgcggcgcagggcctccataaatgcctcataatttggcacatttccggaaagggaggaagcaagctccggcaaaggtttcccatcagtctggctcacatcaaagaccttgaccgggcgaaacatggggatctcgatttctttttcctctgtgatgatctttccgtctttatccaaaatcggagccttggtatccgggtccagtttctgctcctcgattttcttcttgtacggtgtgggggcgatgatggtaatgccatgttctccctttttaacatgacgctcaaactggtctttccacttattgtatccggctaccaaagtggcgtccggcttctgcatatagatgagcatggtgttgtttaccgaatagcggtggaagcgggacataacggacagatagcgcatatacttttcactctcaaacagttccttgatgccctgctcgatgccgtctgtgatttcccttagccgctctcggttggtgggcttatcagccatgatgttcactctcctctctaaattggtgattgttgattgatgttcagcgatccatagcttttgttcctccgggctgtcctccagaaaagaatccagcagatagccgatataatccttttgctgcaccgcctctaaaaaacgggggtgcatgggttcctccggtgttttgggcgtgtagcccgcttcccacttgcggagaagatggaagtagtccgccagaacccgaaaggcatggtcccggttctcccgaaacttctgtgcctcggttttctggcgaacatagttcctgcggggcggggcctgactgtcatagatcaggccaaaatcctgcgccagcttctcggcggcttccttgggggacaggttgtagagccgggcggtcaggtctatcacatcgccggtggctccgcaaccgaaacagtagaaatattcttcgttcagcttcatgctgggatttttgtcatcgtgaaaaggacagcaggccatgccgccccttttgacctcaatcccatatcgttctgcggcttcccggacggtgacagactgcttgaccgtctcaaatacatttgcgcccatcgtcaatcagctttcggtttggggatgggcggcctgtacccggcaaccttggcccgttcactggcagccttgcggcgctcggcgctgtatggctctcggacggacacacagcgtttggggactgtaaaattgtgcttatcctttttgcagacctgttccgggtgctttttggaaaggcgggtcagcttctccatcagttttcggtcatgggtataaacttcggcggtgtcctcggcctgattgtagaggagaatggtttcctgttcataaagggagagcttcattttgcaccgcctttctgccggtcaaattccagcttgaagttggcgtaccgcccatcgtcctccagaaccaccgtagcgtcataggtcttgccggtcttttcggaatagcagccggtgagccttgcccggccatccttgagcagcgctgtcaccagcgccttggtaggctgctttttcttcatggcccaccatttactgtttttccagatggcaaatttgcaggattctgtctggcagaagaaccctttttgcagttccgccacatcaccgccgcagcgggggcatttgcccaccacttcgcggggcggcgtgaacaggtactcagtccccttgatgacctgataggttcccaccagatctttcagcatggtgctgatcccgtccagaaactcctccggggcaagctgcccgcgctcgatctctcccaggcggtactcccactcggcagtcagaagcggcgattgcagctgttccggcaagactgtgatcagggagactgcatcgtgggaagggagaagctgcaccgttttcctgttcttttttcgttccagaaaaccggcagataccagcttttccaaaataccggcacgagtggccggtgtccccagaccttttcgctcggcatcctccggcatatcctcttttccggcagtctccatcgcggacaacagggtgtcctccgtaaagtgctggggcggactgcttttgccttctttgacgattgccgcagaaaccgaaagggtctgtccttcagtcagctctggcacggctttctctgcaccctcttttttcggctctgcatccttcgttttggcacggtaagcgtcctccagtgctttccatccggggtgcctcaccgttttttctttggtggtaaattccccaccggcacacgctgcaatcacaacggtttccgaatagatatggggctgggccacggcgcacagcagacgcagggccaccagctccagcactgctttttctcccgcaggaagggcagaaaggtctgcatccttgagatttcgggtgggaattactgcgtggtggtcggttactttcttatcgttgatgaccgtctgcggatcacaggtaatggcgatccctttgcgaaacggcatagcattggcaaccagattcaccagcaccggcaggctgtctgccatatcactggtcagatagcggctgtcagtacggggataggtgcagagcttcttttcatacaggctttgcagatagtccagggtctgctgggctgtaaatccaagcaggcgattggcatctctttgcagagtagtcagatcatagagggcaggcggcttttcagacttttccttgcactccacctttttgattgtgacagctgcatcctggcaagcttctttcagctgctctgcgcttgctcggtcacttatgcgctccccggatacggtaagaccgggcagctccagcgccacggtataaaaaggaaccggcttaaatgtgtcgatctcagcttctcgctggacaatgagtgccagcgttggggacatcacgcgcccgatgttgagggtgcggtggtacagcacggaaaaaagccttgtggcattgatccctaccagccagtcggccttggcacggcagagagcagctttccgaagtccatcataatctacacctggacgcaggtttgcaaagccctcccttatggcggagtcctccattgaagaaatccagagccttttcatcggcttttggcagcctgccagctcatagacgctgcggaagatcagctcgccctcgcgtccggcatcgcaggcatttaccacttcggtcacatctggggcgttcatcagctttttgagaatatcaaactgctttttcttatcctttcccaccaccatctgccaatgctccggcaggataggcaggtcatcatatcgccacttggcatacttgggatcataactgtctgcatccgcaagaccagccagatggcccacgcaccagctgacacgccagccgttaccctccagatacccatccttacgagcagttgcaccgattaccgcagccagactttgtgcaaccgatggtttttcagcgattaccagtttatatctcatcatcttcagcctcccattcattctgccaattatcagacagtttttttgcaatgctgtgttctgaggcaagtgtaatgtcatagccaaagcgataatcatatcggtacaacctgccaatcaaatcattgattatgatattgcaggccataatcacacgctctttatccacctgcatcagttgatagcgttgataattgttgtaatattctcgatgtctgtgggttctgctgaccgtatcttccatcagacaatctatggcatctttttcaccatcttctttgctgccctgtgtataagacaacagttccttaaccatgggaaaactttgttcatctaccgttacttcttcgctcaaaaaaccgatataagcttttagtaacaggctaactgctgttttttcagcttcagataaagcgttcatggtctccgctgcatcaggcaacagttccttttccacaaattcatctatctcaccagaataaagcattcggattgagtccacacataaagagcgcttttggggtgcggtctcaatttcaaaatcataaagatccaagtcatcgtccttctttgactttttttgaactttgctgatagcagtgaaaagaatgtctcctccaaagtaaattccgaaggcgaccagatcaaaaataatcagaaagtgtaataaccagttccatgtgttcattgtgaggtcctcctttctttgaccatgtgctgattttgggtgtggatttacagtaagagagtgagtagagcagcagaggacaggaatttctccctgtcctctgtcccttatcccgcaatgatttgaaatacgctacgctcaaatggttcaatctgctctatcgcgttcctcattagggtcagaaccctcaaaaccatcctcaaggacttcctcatcttcggtttcccattcctcggaatcttcctcaccataatcataatcgtccagactgtcattgcccttggtcttaggcttattcttaacgagcttcaagtaggcaaatacgccaccgccgcccagcagagccagcagaaggatcagcgcagccgggttcagtccggcaggcttctctttttccggctccgatgtttctgccggaggttccggtgcttttcccgtacatttactcttatcagttacacagaccggacaggccgtattgactgcccctgcttcacatttcttcgtgcaactgcacaccgcaggcggctcctctttgggttttccatcctccatcagcgccatcaggtccgcttcatccacctggttcagaaagtgaacagcagtctttttatcctcattggccctgtcgatcaggatataaaaatagttgcctgccttggtggtaacggtaatgagctgcttgttgccaccaaaatcatccaccagagcggcgttgccatccggggtcagcggaggtgctttttccgtttcttccaccaccacattgctgtcattggtggtatcctctgccgggggcggcgctgcgccctgggcaaaagcgggaacagtaaagcccgatgccagcaccagcgtcaggcaaagggcggaaagtgttcggagcaatcgtttattcctcatagctgttttcctcctgttcgttgttgtcatcagccaatctgccgggaactgtgccgccggacagcatggcgctcagctgagccggggtcatacgcagtgcgcgcaccatctggacgatctccagattttctgcctcggttttctgtgcctccagcgccttgagcttttcctgatattctgcgatcttcttgtggacctttgtaatctcctgatcaatgcgttcaattttgttctttgccatcgtctatcactccttctaaaaaatctctgttaccagttcattaggccgtagcctttgatactctgataattcaggtcataacttttgatcttgcaggcatcgccggaatttccctccacggtataaacacggctgccatcggtgccgacaaaaattcccacatggtctgcggaaccatccagatcccaatcgaagaaaatggcatcaccgggggcaatgttttcatatcctcgtgcgccccactgtccatgagactggaaccacggaacgccctgagactgacaaccagcaaagcgtggttccgttcgaccggattgaccatagcaccatgatacaaagcaggcacaccattccacacgggagtcaaagccgtaccagctccaataaggttgtcctcccacattgcccacctgacttttcgccagttccaccagctgcggattgccggggcgggagccattgataaattcaacaccagtcaaatcttcagaaacacctgtatcgggagaaccgccaccaaacaacagcggcttattgcccatagtctgtcggtagacctggtacatctccatctgctccggagtcagtagttctggcgcaagagaggcaatggaacggctcgttaaagttacatggagaatacgatattcatattcatgctcatccccatcttcgtcagtgtaagtgcgaatctgaatttcttctctcagcgtgagctgatactgtgcatcaaacacacgactcaactctgcctgtgcgctgtggcgtgtatagccttgcaagacagcagagagaactgccgccagctcatgggggtcatggccaatcatatccaggttatagcgatactcgtcataccctgggtggctgctttcgatgttgtcgattttctcctgcaaccgagcttctctgtctgcataatctgcctccaccgccagcatttccgggtcatccgatggataggtagtgccggaaattacagaaccaatactctgtgccatcatagagcaggaggacatggtattcatcagcatacaggcgatgaggaacaaaacccctgcgatcaggaagcccttcttgtggcgcatgacgaatgcccctgcctgctgtgccttttcttttaccgtccttgcggcttttccggttttggacgcagcctgggcggtatttccggcagtctgaccggtgcgcttggcgacggcatactgctttttgatactctgtttttgctgccagcgggagagagggttgctggcaaactgaggattttcccgtagggacttctggtacagggcatttacatttgccttttccagcttctgctcggcctgggctgctttgcggtacggcttcagcttgtggctgcgatagccctcccgcaccagataagcgctggtctccaccgcctcctcggacttgtgggcgctttccacacccacattgtcctgttctgtttcccggatctctttgtgaaacttgcccgcgaccagatggacgggagcttccttaaccccttgagaaagtttggaaggtggttttttcttgtcctcaaaggtcagcttcgaggtctttttcccggtgtccgggtcaatgaccgtctgtctgacttttttctttggaatattggcctgcgccttatctgctctggccgtagctttctccgttttgcggatcggcttttccagtgcagggtcagcccgttcctcatcagtaaagcgcaggcgcggctctttattcaaaccaatcacccattaggatagcatccatcatgtggtgcagctccacatagagggccaaaccttccggatcatatagcggatgcacggtgagatacgcatggacttgcgccagaatctcagagagcattgtgataggtctgcaccctacaatggttgctgcaccaggggcacacatcatattcgcccaaatcgaaaagagacgggcaagaccaatttcgccatcctcattcaaggttttgagttctttgtcagcggtacgacactcaacaacagcggaggccattaccggaagcaacatgaattcgtgagcctccaatgcctcacggaaaaaaatcatggtatcaagttcgcaaatattctgtttcatagttattcatcctcctttttcagttcctggggtttggtggtcataatgcggtaaagctcagtattcttcgggaagtggtcaacgaagggcaggatggtggagccatagaacagcaggccctcgccctcaccggagtgggtcacatagctaagctggtgcgtggaaatgcccagctgcttggcgagaatctgacggtctccgcctgcctggttgagcatatacacgaagtcggagttttcaaagatgttctccacctcgcggctactcaaaaggtctttgacattctgggtgatacctgtcggaataccgccccatttgcggaatcgcttccagatttccaccgtataagcggcggtctgctcctccttcaaaagcaggtgcatctcgtcgatgtaataacgggtggacttgtgggcagcgcggttaatggtaacgcggttccacacctgatcctggaccaccaacataccgattttcttgagttgcttgcccagctccttaatgtcatagcagacaatgcggttattgatgtccacattgctctggtgattgaacacattgagggagccggttacatagatttcaagggccgtggcgatatactgggcttccttttcctcctgtgaacggagcaggttatataggtcctccaaaaccggcatattctccgggcgcgggtcattgaggtaagtctgatagaccaggcgcacacagcggtcgatgatggttttctgcaccggctgcaagccctccttgccgcccacgatcagctcacacaggctgagaatgaagtcgtacttgagggacagcgggctttcatcatccgaatagtccaggttcaaatccatggggttgatgtagttggtggaagtaggcgaaatcttaatgacctgcccatgcagacgctccaccagaggggcgtactctgcctccgggtcgcagatgatgacatcatccgaagtgagcaggaaactgttggcgatctctcgcttggcgctgaaggacttgccggaacccggcgtaccgagaatcaggccattggggttcttcagcagcttgcggtccaccatgataaggttgttggacagggcgttgatgccatagtacagcgcttctttgccgttctggaataattcctgggtggtaaacggcacaaagatcgccgtggaactggtggtcagcccccgctgaatctcgatctgattgagacccaaaggcaggcagctcatcatcccttcttcctgctggaagtccagacgggtcagctggcagttgtatttctgcgcgatggagcttgcctgaaacacattgttgtccagctggcggggattgtctgccgtgttcagcaccaggaaggtcacaaggaacattcgctcgttgcggctctgcaaatcctgcaagagctttttggcctcgacaccataagtggcaaggtcggaagggatgatgtccatgtcatatccggcacggacagcttttttctgttcctcaattttggatttatccagatcggtgattttccgcttgaccgtcttgatggccttgatctgatccaccgactggatgtgcaggctgacgatcagcgagctttccatgtccagaaaatcagccagcatccggtcattcaactctggggccaaaatttgtacgaagctgacggctccgtactttttacccatgcggaactgcttgccggtgcggaactcaaaggagctgggggcgataaagtccttggtggacaggccgctggtggggagccagtcccactcaaaacggaacggcagctgctcatccatgtggaagataccatgcagctgggcaagccgcgcctttccgtccagcgtttccgccgccacacccagccgcttgaagttattgagaatgtcggtctcaatgcgctccaaacggggcttggccgccttgatgctgtccgcgtcaatgccaaaggtgagatacttggttttgataaggccgttgttgccctttgccagctggttttgcagcatggtggtgtactccacccggatgctgtcaaaatcgtccctttgaagggggatgttgatggcgcgggcaaaggtttcctccgatgcggcaaggttcaaaaaagacagctcaaactgaatcgagctgtcgaagtagttgaggaaatcgcaccagccctcgaagatcgcggttttatcctcgttctgtgaaagctgatagttgatgtcctgaaactgaatggtttttgtgtagtgaccgtctgatacccggcagatcccgtccggccacatccgttcataagggatactgtcctgcgcggatttttcctttttgtccgtgcgattggcgcgggcaatggcagcttcaatctgctttctgtcggcgcgggacagctttttctttgttttgaccggctgcacagctttttcctcggtttttccgaacatccgatgcagccatttttttattgcggtgaacaatgtcatacacctccttatcgagcatttcctgccgctttaatacggcataaaagttgttggtctggtaaggtcgctgcttgggacggatcacagctactttgagaatgttgcccacgatcttttccaggggctgtccatgcttttcgtacatagccagcataaagaagggcagcataaccagtatcatacacatagccgctacactgtttccggtaggttttctgagcaaaaagaaaagcggtacgccaataagcgctccgcccgtgaagcagataagctgccgcttggtcagattgaacatgacctttgttttgacttttgttaagtccttgggtacgggtacataagccacaattacacgctcctttctgacagcacctgataaatcccttgcatgatgtaagcaacacagggaacagccacgctgtttcctaacatctcatatctctttgaatcactgattatcccatgctcaaaatcgtatgcggtccatccatccgggaatccctgcaaccgctcacactccataggggttagccgacgcacaatatattttctctccggttgggcgaccaacgctccgcaaggttgatatgccataagagttggagccaattcctcctgataccctatactgccggccgcacttcctgctttatagcggaaaccggcgctgaccatggcgggcggagattgtgacatagcagctatgattggcagatttccgtgtgtctggcttcgcagagtaggagaaatattactgcgctccacgctcatagaagctccgccctggtcgttgagtatgacaagcggcgcaacaaccgcatgacggtctgcccctgtcagggtataagaaatgtcactttggtatccagctccatttccaccgttatgcggctggcgtccaatgatattgcccacaatgcagtacacttcggtatcgctcaaatatcggtcttgcgggactgttcctccagcgctgcttgcagcaaaggaggtaagtgcttgccgcggcgttccgcccgattcaaaataccctcgcaggcttttggggataaaaagtatttgtccggcgcattttcctctaaaatcagcgacaaggaacacgcgcctgcgtcgctgtgctgttccgaaatattgggcgtcgtacacgcaccaagcgagatcaattcctcggcttcgtaccattccggcgttggcccatcgcccagaataaggcattggaaccggggtttctgtgaacgcttgcagcacagccgcaaagtcacatcctcctgcggatgacaaagctccggggacgttttcccatattgcgatttgcggatattgtccatgtgttacctcctgcatttctcgaataatacggattgcttcagaaaacaacccgctacgctcatctgctaaccctaacctgcgtccgctgatggatagcccctgacagggtgaaccaaaagtgatgatgtccacaggtggcagcttgcgtccgtccagttttgtaatatctcctacatggaccatttctggaatatgccgttttgtgaccgatatggctgtcggcagaacttcacttgcccagacaggacggattccataaaataaggcggcataggggaaaccccctatcccgtcaaaaagtgttcctaaagttatctctttcataatgtacctcccagcaatggtttaatgagcctgaaagactgattttgcgagactgccggttttgaacagcgtaaaacatagcagtacggtgtagcccacgcagctccagatcgccatgatgatgtcatcttccagagcgatgttctgcaccagcacagcataaattgccacgcagacgatgatgagaaacgcctgaaagcccagcgccagcagggagcgcagatagttctggcccatgccgccccattccttgcccatcatggcagccatggggatgggcgcaacggatgtcacaaggtaaatttcaatcatacggccataaatcacgataaagatacagatatacaacgcccacatggtaatgccaataaagagggattggaaccacagtccgaacagcggtcccagatccatttccatcagcctcggttccagatcggtcataactgaggaaatgtcaatggacgcatccgaattgataatccctgccgcctgcgccactacgctctgcgccatatcaaagacgcccatcacgatattccatgtatttgtgacaatgaggatggcagcggctgatttgaacacccacttgaaaatcatccaggtgtccacatcatgcaggttgttcttgtctgcgatcatctggatcaggtctacggtcatcacgatagccaggatcacgcctgcaatcggcaccatgatggagttggacagattctcaatcatgctgaaaatactgccattccatccctgtggggtctggcctacctgtacggatatatccgcgacctgctggtttacactgtcaaacatccccgaaaggttgctcataatgccgcccaccagcatttctttcagccaatttgtcagggcttcaagtaagaaatccatacggtgtcaacctcctttccgccgcccccgcaaaactgcgggagcggcaaggatttcatacggagacgcttagacagagaaaagcccggagagcagaggtacaaggaccatgcctaccacggctacaccagcaccggccatgagctgcttcatgccctggctcttggcgccggggttgtcgttgccgtaaccttccagcaggttgataacgccccagataccgagaccggcaccgagcgcgataacgagggtctgaagaacggtgattgcctgttcaaaaaatgccatatagtttgttagccggaatctgattaaaaaataggtttgtcatgtttcataggcatacaaaagccggaacaatctgccgcccggtttccgggggcatgattccggctgtcctcctttttcattattttttctcgcgattgtccgctttgtacgccaatggcccatagagggcagatgcggcgaatagataagatcactcccttctaaagcggaacgaaattaagcgccctttgtgtctacttcatatacatcgcagacctcattgggcttgagtttcagccttgcggacaagaatgcttcaatatcaaaagcgttcttgtcatccgcgtcggcagtgtacttgaaattggggtgcttggtgatgtcgtacttatccgaaaggaaaggacgcacaccgcgcagctggaggatacacttgccgccatccataacagcaagctcatcctggctcatcagctctttccccaatttttgatagttgagtgaatgggatgtttccctcccacggctctctccggtgttgtaggtgtcgatggtttccttacccagcacggcggccagctccttgagagtggtcggctccttaccgcccagaaagatggaagtatccatgtttccgataatggtatctgcgttatccttataaatcgccttgagctgactctgcgcctgcaacaccagacaggcggagatctcacggcttcggatggtggccaccagcttttccaacttgggtatctggccaatgttggcgcactcgtcgatcagacagcgcacatgaaccggcagtctgccgtcgtacacatcgtcggccttttcgcagagcaggttaaacagctgggtataacacatggatataaggaaattaaagctgtcatcagtgtcactcatgatgaggaacagggcagttttcctgtctcccagagtatccagctccagctcatcataagccgtgacctcacgcaactctgcaatgtcgaacacggcaaggcgagcgccgcaggaaatcaaaatcgacttggctgtttttccagagacaaattgtcaaggactttttaatcaaattcacaaaaaatctacaaaaaaggtgccagaagcattgtatggctcctgacacctcgtttgatagattacatttttccgttcagcaggtctttgcagagatacgcgtagtctggcagctggttgatatatgactcccagcgccgcttgatttcggccaattccagcgggtcggctgcttccagtgcatgatcgttgcccgtcatatacaaaacatccgtagcaacatcgtccaaacacctgccgcagagatcggcggctgattctatcctgataccggtatccacataaagcggatttacgccaatcgtcagccagacatagcccaccttgtccgaccagagcagttcaaaatcggggctttgccgcagatgttccgcaaagacttcctttactcgctcaatttcatgtttctctttttctgtgtaaagcatttttgtgtcctccttgacaaaaattttggtgcataccatcatcagtttagcacaaggcggcttcgtttatcagtctgtcacatctgctgaatttcatttttgagcatacgcttgattttatcgctcatggtttctgtgctggtattgctgaaatggacatgaaccttgtaggtcgtcttaccgattttctttaccatcgccggcgtgttttccggcgctctggacgcagtaacggcgtctgccacctgcatagtacggggttctttgttcatggcgctcctttctccgaacgggtctgtgccgcccggtaaaaaatcagtcgtgcttactgtttacaatgtcttttgctgtctgtcgggtagcaccggcattttcttcccgaaaattcttcccgtcaaagaggatcggcgcacaccgttccaaaatacggtcatagatacgggcgtgggccagatcaggcgggtttttcagctcggacagtttcaagtttgttgtgataatcatgggtctgcggctgcgatagcggctgtcaatgacgaaaaacatctgctccatagcatattcggtactgcgctctacacccaaatcgtcaatgataagcaagtcatactcatcaaagctggcaataaactccgacctgtcctcagcgaacatcccggtcaggcggttcagaatggtgggaaagttcgtcatcagcaccggcacatcctggtcaagtagagcgttggcaatacatccggcgaaaaaagacttgccggttcccacatctccaaacagcaaaagcccgatattgctcttatatgcctctttccagttctccacataggcatgagccttgtccatcaatgggttttgcccgttatcattggaaaatgtgtagtcgtacagataacggtcttgcaagccctgtgcctttcggcgtttgatacgctccatacggcgctgccgttcttcagcagccttgcgctgctcctcagcttcccgctggcactggcagatgcaacgcggcataaagtagccggatttcccaaagcatggcacaacggtctgcctctggccgccgcatttcttacagtgaatgagcccgtctgacaagtctatatactcgtcctcagccaattccacaccggcagctgccttgtcgatgaacgcccggatttctgcggtaatctcaatcatacagtttcatcctcctttacgctgtaatcccggttgcgtgagggtgtgacagtttttttagcgtcctcaccggcccagcgccggatggtcgctgcatggctctgataacgcttgccggtagaagccatgtactcggacagtttttcgatgtactgttcccatacagcaggaaaactggcctgcaagtcagccagttcttcatccgtcaggaaaatattctggtaacggccataggtgtgggaagggtgccccatttcagggcgtaccttctctatctctctctttatctttatctctttctctaactctatctctatctctggtggacgaatgtcggacaaatgtccgccacttgtccggagcgcagaaagagccttattttgaagccttgcagcccgctttcgctcagcctcggtagaggactggccgattaaaagttcgatgttgctcatgtagaatgtgccgctgtccagcacttccacaagacccagcttcaaaaagatttgcaaggctctctccacagtgccgatctgctggcgggtgatggtggcgattatctgcgccgtgtaaggaatgtcctcgtcaagctggagccgcccgccatgtttcagcgatttcagatacagcttgagcagaatgttagaatacagcacaccgtcctgcatactttccagcagcacgatagaatcatcgtcaaaatagttttctttgagtttcaggtaataatattttcgattgtctgacatagggttcctccttggggattctcttgggattctgtacgcattttaaggctattttaggagtcagaggataaatctatcagcctgcctttgacaccctcgaaaaaagccttgatttacaagggtttttcagcccctaaagcgtgacatttctcccgttgtttccgcttgcgctttgcggcgttgatccgcttcatgcgcgcggcacattccgggcaatatttggccctgttagaaccgggggtaaacagcgccccacatacagcgcatttcttcgcattcagtcggtggaacagcgccgtttccagttccttatcctgcggcaataccgccgcccgaaaccacctgcacaacagggagtaggaaatggactggacacagatgcattcctccccatcgtccagggcgatacagtttccgtcaatgtagttacagcactcatgcaccagcctccgcgctctgcggtactggcggtaatccatgacagggataggttcagtcttgttgttcttcataaatgatttctttcataaagcgtgtaacctcctcgaatgaatttattgttaaatattcgtgcaaagtattgttttcttcgtgcaaatggcatatactataattgccagcagaaaggggttgatcgtatggctggaaataccacaaacatcagtatccgcatggacgcagatttgaaagcgcaggcggacgcactgtttactgaacttggcatgaacctgactacggcgtttaacatctttgtgcgccagtcgcttcgtgaaggcggcattccctttgaggtaaggctggaacagccgaacaaagaaacggttgctgccatgctggaagcggaaaggattgcaaaagacccgtctgtaaagggctacaatgaccttgacgagttgtttgctgacctgaaaagatgaaagaaaccaaatataccgtcaagtacacgaccagtttcaaaaaagactacaaacgagccataaagcgtggcttgaagattgagctgctggagcaggtcgtagcattgctggcaatgggcgaaccgctgccggataagaaccgcgaccatgacctgtccggcgattgggcaggccatcgggaatgtcatattctcccggactggctgcttgtctaccgcatagaggatgatgttctggtgctgacgctggcccgcaccggcacacacagcgacttgttcggcaaataaacagtctgccgccgtatggggaaacctgtacggcggtttttctgtatgcaaaggtatgtcgtgaaacgcgacacacttgacaggggtacgccaaaacgcggtagcctttaccgctccggcccacggtcgtgagacttgtccctttcctgtcgggacagctgctcggcggttttgcggagccgttccactgctttcaaatcctccctcatggatttcatggcaagcgtgtccgtctgctttccggcggtcagctggtcgatctcccgctgccatgccttcggggtgatcccctcgccgctgtctttcagttctttcagataccaggctgctgcgtcatacaggatcagttcccggctgtggcgctgctcaaactgttcccgcttttccggctttactttggcaagctgtttgtggatgggcttgtactggttgtactgttcccacatctccccgcgttcggtaagaatggcgatccggcgctcagccttgacaatctttccgcgaaggtcatagtaacggctgttcatatcagcgattttttcatgaagctgctgcatagactggatgccgtttgcctgtaaaaagctgaatagtgcagcgctttcctgcaaagcccggattttgccggtgcgggtgcggggagtgttcaactgctgctgggcctcccacaaagcagtcaagctgctttgctgtgtttgtggtttttccgcttcgtctttcgaccagcgataaagacgggtaatgcgggctttaatttctttcagcagtttgttgtcggcgacgatctgtcggtttacttcccccttgtcggtgcggataccgcgcttttccatttggctggcagctggccccagatggacagagggaattttatcaatgccctgccgcttgtaactgcggtggtcaatgcgctccggtctaccggcagattccagcgcccggttggtgtaggctgtccacgctgcccgccaaatctccacatttcctttatcgttccagtcggtcgtatcctcccgatgatttttccagccgcctttcccatccgggatacgctgtccattctcgtccagatcgtatgccttgcggcactttgcgccccactgtccgttttctttcagaggccggagcgtcagcatgatatggacatgagggttgccggttcccttgtcatggatggcaaagtcggcgcacattcctttgtctacaaaattgtccttcacataggcacgcacaagggcaagctgttgttcgccggacagttcacggggcagggctgcctcgatctcacgggcaagctggctgtcccttgctttctcgatttgctccacgctgttccagaggatagaacggtctgcaaattctggcggggcgtgggcaggcagcatgatctccgcatggacaatgccgcctttccgggtgtagtcgtgggtcattccatcccattcatttgtcagcttggttccgctgcggtaagcagctgcggcaacggcagaacggcctgcgctgcgcttgatgatactgacggggatatgacagaaatctatggggaacacctcctttcagtgagggggatagcaggctctgtggagccggacaaatgcaaagcgggtgtccgacgactgcgcagagcgcacaaggggtttggggagcgtagcttcccatcgcggacgaagtacgcaacgcccccggcagggcgcacagcaccggcaacggtgtataagtgcgcccttgtaaacaagggacttatggcgtgtccccggattttggcaggtttgcagttaattccgcagcccccggaagatgggacagggtaatcagaaatgctttgacctctgcgccggaaaggttggaagccagtgggaaaatcccctccaaaatggctccgcgctcaatcaggcggcgggtgcgaaccctgcgttcttcgttccgctgcttgttctccaaaatcttcttgcggttttcaagctgccggatctccttcaggacttcctcccgttcttctttttgtgggtgggctgtaattttttcgttcatgtcaggcacctcttttctttggaaatactcatagattgaccgtccatttctgtcgagcaaagtaccggcgcagtctccgcagtgcggcatggatggattttcccgcctgtgctggcgtgataccctccattgcggcaatatctttcactttcatacccagcatatagcgggcgtgaacacggcgagcctgcataggcggcagggaggaaatggcttcatacaatcgccgtatcagttcttcgtattcggctaattcttctttttctatcaggtagtcctccggcgatggctgcgcccagccgatggcggcattttcgattccatcgttacaatcgagggaataaaacgccttataccggaacatcttgcgatctctggcggcctcggctctcttgtccagaagaaacgcttcgacgatctcatcggacacctccacaaaaatgtcctctttgcaaaatggataatattgtttgagattgatggtctgcataggcatgccctcactctgtttggaaaaagccatcatagcagcggcgcatattccgcagacctcgacggatggcaacgctgaccttgctgctgtggacgccctctatccgagagatttccggctgcttgataccagcaatgtagtaggcgtgaacacggcgggcctgtgtcggagtggcatgagccagagccaccggcaaagctgcaattaggtataggcgggtggtcatttcttctcgttccagcaaaatatcttccggcgatctgctgtgttccagtgcgtaattttccagccagctgtatgcgtccagagagtagtaggcgcggtggtagactttccgacgctcatagttctccatctcccgcttggcctgatacatcgctgcccatacctcgtccgtaacatccacaaactcgtcatgccggtagtggggatacatccaccgcagattgattgttttcataggcttacctcctgaaaatcggagaggcggacagctcgtccgctgtccgcccctcgctgagataagggaaatgatccctttcacttggtagccagaaaacaggtcattcgttaagcctgttctcaaagaaatttataaatttttttctgaccgcctccacactttgatacacagccactttggagcagccgcacagcacaccaatctctgcaaggctcagcccgtcaagcgcatagagcaggaaccggcggcgctgggcctcggtacaggtgtccagaacagccatcagctcatgcagcgtttccatgcggcaaaggtattcctccggcgtttcgccgtagacccctacaccctcggtggtaatgatgtactcgtcaaactcccggccatcccaatgccgccgctgttcatggaacaggttctccgttttatgatcggcccggtcaagaaattcatagacttccagcgtaacctccacggccacagcttgtccgttataattgatggtaacttccatctgtctttcctccattcagatttttttggtaaatctgaatggggcggcggagaacggcactggggccagggttcgggccatgctggcccgatgtttcggctccatagggacaaaaaagcgcccggacggcataaagccatacgagcgtaatagagtatattttgctgtttagttacatggtatagtgcatacttctgaccgcattgctccgctgctgggaacaggctttttttagctggtgcaggtcatggggactgtgaaaaaaggcaaaaatagacacggcggcaatcctcctatgtgccgccgtggatttacacggtgttaggtcgtcgttagattgggatagacgaaaagaaacggcggctctgatcttctcaaagccgccgcttcataggcgcgtggaaatgtgtctgctgtacgacggcttttttcttttgccgtcgtgcggcagaatgttattcaatattcaattcaatgtttccagtaaagtcctcacactcaatgccgatataatttccaccatcaggaagtgtaattgtgtcactataagttccggttgtttcaatcaaagtgactgcttcatccgatccagaaatccaaaatacttttgcagtaccttccgtaacctccaaagtgcagtcaatagacagctccttaccggcttctctttttatggaagttcctccgaacacatactctgtatctgaaaaattctcataatcagccgtataagttcccgtataatcatcgatccctttttcttttgttccttccaaagataactttcctgtaagctctatggttccagctgactgaacgatattattataatgatcgagaatttcatcttttgaacagccagaaagcataaaacttccaaaaagaacaaatgccaatgctaaaactgttttcttcataaaatcatcaccagcctttctttggtgctacctttttggcctttttctttgtttgggttgcttctcgctctttcatgcacaaaatcaagatggcagaaataacaacagcaagcacaagactgcaagaacaggttccgatattccagttgactgcggtatcatagctacggtagcctaccattccgagacttgcggtaatcggataaaggtttgctaatgtcatatttcctgcggcaaacatccctccatatccatagacaaaagcaatgattacaccgactaaaaagctgcccgccctccgacaagtaagagcgataatcggcagaaccgcaagatataaaaagaaattaaccgcggtaatctgcaaggttgcttttagtgctaaggaaatttcaaagccgggaaatcccacaatcatttctgctatgattgtaaacaggctgcatatcagcccgaaaataatagacaatacgccgcacacaatcaatttcccggtcagcagtttcttaaaagagatcggcacagtcagaatatttttcaatgtgtcatccgtctgctcacgagaaatcatatatccagcaattaggctgatacacatcggaaaaatcatggacatattgtttttgatgacctgttctgtaagataggcgaaatcccaaacggaaccatcattcgccatagaggtaaacaaggtcagcaagacggataggagcatgagcgcaacacccgcccaaaggatatgataccttttcaatttataaaattctgtttttacaatgcgaaccatgtttattcccccctctgcttatataatctgtcaatcagtaagaacgaaactaatgccatgatcccaagaatgaatacaacttgaaatgttgaaggaattagccctgtcatttgctccaagtccatttttattccatgagccgccatatctcctgcactccaaaatgtagtcagtggcgtgggcagaagccataacatggttttaggcagtgtgtcaaacaatgccgtagcactcatgttcagaacgctgtaaaagacacacagcaaaatggaaaaaacataggtcttactgaaaaagacaacaagaacaatcaacgggagtgttcctgccgtaatgaaaattcctgtttcaactgctaaaaacaatttatagcctgttccataaacttctaatgttccaaatccgcaaagaattgttgcaatggtagaagccacacaaaaaacaattccaaagagaaacaggacaacaatttttgcaagcaccatttgcgtgctggttacgggaattgtacgcagatttttgaatgtgtcgttgtcgcgttccataaaaaacaggatagcggcaatcacaccgataatgcagggcaataaaaactggataccatatcctaacaccatgttaaatagtccgtcgaaagcatctgcctgatccgtatatcgctccatcatagagggcgttgtcatcagataagtcagcgggattggaaacagaaaagcagccagaataatcagcggaataaatttcttccgtttcaatttcaaaaattcgcatttgattagtttaagcaattccttcgccccctgtcacacgcttgaagtaatcttcaagactttcttcacaagtatgcgcctccgatacctccaatccattttctacaaaggcagttacaattttccccacaggcagatcaaggttgtgcaggcgcagattgtggtcgtcctgtatagagaaatggttttcatggaaatttcgttccaaaattcttgccgcctgcgcagtatcagagagtgtaaaccggatatgcttactacttttttgctccaactcagcaaggctttcttcttccagcaatgcaccgtggtctataattccaatatcgtcagccagcaaggaaatctccgaaagaatgtgactggaaatcaaaatggtttttcctcttgcgtcgcaaagctcccgaataaaggagcgtacctccgcaataccgatgggatcaagaccgttgatcggctcatccaaaattaaaagttccggatcgtgcataacagcaagggcgatggcaagccgctgcttcataccaagagaatactgggaaaagagctttttatctttgtagggcagtcctaccaaatccagagcgtctttgatggcatgattgtttggtacgccccgcagagtagcaaagatacgcaggttctctgtgccggtcagattgggataaaagccgggggactcaattaggctgccgatacggggcagcaatttcttttcattcccctgcaaagattttccccagattttgacctcaccggaggtcggcttcgttaagcccaacaacattttcatagtagtggtttttccggctccgtttctgcccagcagaccataaattctcccacgcttcacatggatatttaagtcagccacactcttttgtgagccgtattgcttcgtcagattttttgtttcaatgatgtaatttgtatccatattcaaaacctcctgttctgtaaggtattctatcacgccaaccttgcattaaccttgccgcaaccttgcattaaccttgcaatttagaatccggccaaaatgacaagggttcccgccataaagacgggaacccgcttaaatctccaaaggaaaaaacaacataaattcagtcccttttcctggtacactttcaactgttatgcttccacccatcttttctacaagctggtggacaatagaaagaccaagaccgctgcctttctcagagcgtcctttatcacacttataaagccgttcaaaaatgtgtttcaaatcttctttctcaattcctactccattatccgccagcagcagctccatgttattttccttctttgacaggacaattttgattttgtctgcatggctgtgagcgattacattttgaatgagattgttgacgatcctcatatagctgtccatatccaatcttacccggacaggctgttcgggaatatcaatgtcataatcaacctgtttatcctcaaaaatcggtatccagtcaatcaggatatttcttgtcagctctgcggcctcaacgctctggatttctaaagcaaactcgtcagaatttaacttgaaccagtcaaagagtacatcaatatattctttcagatcatgggcttttcgtcgggcggtttcaatatcatcatcccggtctcttcctgtgaccagtcctttgtgtgcagcgtcaagatacccaatcagagtagtaaggggcgttcgcacatcatgggaaaggctcgtcataagctggcggttggtttcctctgtctgccgtacagttgaaagtctgctttcataggccacaacgatctcattgatttcataggcaataggtgctgtcagttcatttgttgcagacaaaatacgccgattgccatttccatttttcacatcaaccagtgcatcggtcatttctgcaatttgcttttttacacgccggacaagaaagatggaggtcaacacagccacaacagcaatcacaatggacaagaaaacgatgatttccatgctggctacacctccttattaaaccggtagccaatccctttgaccgtttgtatatactttgggcttgaaggattgacttctaattttttacgaagccgactgatgatcgccataatgttgctgtcgtcatagaaatattcttcaccccatacttcctcataaatctgctgtttggtcaaaatttttccttgatgctttgcacagtacaggagcagatcaaattcctttggcggaagttcaaaagtgccgtttgccgtcgtaacagaacgattttcaaggtcaatctgcaatccgtcaaaatccagtttttgcacagctccggcttgctgattaaagcgagtgtagcggcgaatgagagaaacaattcgggcaatcagttcgtccatatcaaacggttttgtcagataatcgtccgccccagcccgtaatccccgcactttagaaatgctgtcatttttggatgtaaacatcaaaatcggcaggctgttctctttgcggatttcttccagcgtttcaaaaccatccataccgggcatcatcacatccagcaccacaagctgatactcctggtcttttaatttctgcaagccctcttttccggtattacaaaaatcagcttctatatgttccgattgtacgctgcgtttaatcaaagcgcacagttctctgtcatcatctataatcaaaattttattcatggcgcagttcctttccttgttttgtccgaccatcaatcggcttctccgcagtttttgggagaagccaaacaccagccattttcacagcgccggggatacgccctccggcgcaataataatttaccctacgaggtgttacgccccatttctcggcggcctctttcaatgtcatatagtccatttcgcacctccataggatatattatagttctctttctcgaacaatgcaagaaacgaaatatgaattataaacttcaactaacctgcatatagcaacattccacgggcaaagtatgaattatacaatgtaaccgggtgatgttatatggcgaaagttgaagattgtcccggttttgaaaccttcggcgcagatgtcaaagccgcacgagaggcaaagcgtctggcacgaaaaacattggcagaaatggttgggattgaatggcggtatcttgccaacattgagaatcaaggtgcgattccgagcctgcctgtgatgatccagttgattaagatctgcggacttcctgtggaacggtattttaacccggagatcatgcgggaagaaagcgaacagcggcaacgggtcagccacaagctgaagctttgccctgaagaatacctgccgattatcgaaggtgccatagacggggcgctcaaaatggaacacactgcgaagcagaaggaggacgcataatcgcggcctccttctggcgtttctatatcaagtttcccggcacttttcccaaagttcccggcacctctgctggatttctccggtttctgtcacagtcagctcgcggtcatttccggtaatcttatcttccagaaagttggcgtatgtacccaacaaagcgttccgtaaatcctccggagttttctgtatttcggcgctgtaccagtcattccggtgaggttcccatgccatcaatgtataaccgtggctggtctgcaccacctcatacagaggatcatcatccagatatgcctgaaacactttcaaaaccttttcaaaggtcagcatttcccgcacctcccattcagctgcaaatcagttccctgattaaaatttcctcaatctgtgccgttaatgtgttcatcagccccacccaacgcataggatcacaggctttcagttcctccgtgacacccgcagcctccatcatgtgaggtaacatggtgtccatacgctcctgcgctgtccggtcaatctctaacaggtgtggatacaacttctcgctcatcagcagttggttgtagagaataggacgatgttccttcaggtaggattttcgcatcctgccgtacttgccgatagaagtttccggctgttcagaaagttttaggttgggtatatcataatctccacaacgaatgtaagtcaacttattcatattcatgctcctttgctccgtgatggttaaaccgctgcgctggctgctatgctgcctttgcgcggttcttctttaggcagctggctaacagtagaataaacgccttttttcatgtcctcagcccggatcagggatttcttagcgtccatttccgcttttttcttcgccttgattttgtcctcatatcgtttttgtgcgccgctggctttccgcttcaaatagttctgatgaagcctgtccttgcgttcttcttttttccgcagttcttcctgttcctccgtggttaaaggaaccggctgtaaggatggtggaatatagcgtcctaaaaaattaaagtagatttcaatttcctgcgtggtatcctgactgccttttcgggagcgttcatggacaaggattttctctacaaactcgttgagcatggtatttgtcagcgtgtcaaaattctcgtacttatcaatcagggctataaatttctctgctgatttctggctctgctcatagccggtaacagccttttccaactccgcaatttcaatctcaagtgtgtcctgctctttggcatactgtgcatcaagcgccttatatcgtgtatccggcagcttgccgagggcgttatcctcatagattttgcaaatcagtttttccagttctccggctctcttttgggcagtagccagacgcctgcgctttttcgatatatcggcactctgttgagcaacctgcgtctcctgaacagtgtgaataaattccgtccggtcatttctcgaatattcagcgatagcccggagtgtgtcggaaaccaatgtcagaacagcactctcattgatacggtgttgtgtaaggcatagtgtcccacacggaactttggtataattggaacaggtatattgagaaatccgcttgccattgttggtgcggtggacatacatcttgccgccacaatcggcacaatagagtaagcctgtgaggggagctgcttcgccccagccgtttggataacgccgtacattgctgcggattttctgcaccagatcaaaggtctgctggtcgataatggcttcatgggtattctcaaagatcgtccactcgtcctcagaaacatagtggcttttcttgtccttaaagtgcttgcgggtcttgaaattgatggtgtgccccaaatactctcgttttttcaaaatgttcacgatggtagatgatccccatccataggggtctttgaccggctttgaacggttcacaccctcgttgaagcgggcaaggtgtacgacaggaatttcaatccggtctgcggataatttgcaggcgatctgataaggcccatatccctccagcgtgagggaaaagatacggcgtaccacttcggcggcttcctcatctaccagccaatgttcccgcttttcatcccacaagtagccgtaaatcacggtgcctgtcaggtgcttaccgctcatgccttttgacttaaacacagagcggattttccggctggtatcacgggcgtaaaattcattcatgatgttgcggaacggggtaaaatcgtcatcgcctttcagactgtccacaccgtcgttgatggcgatcagccgaactccacgctgccgcaaaacctccatgacctgaccgaccttcagatagtcgcgccccaaccggctcatgtccttgatgacgattgcctctacacgccctgcctccacttcctccatcatcgccaaaaatccagggcggtcaaaacgggtgcctgagataccgtcatcggtaaagtgcgtagggtttggcagtccattccggcgggcaaaatcctctaacatctgtttttggttggatatggaattgctctcgccctgtaactcatcgtcccggctcaggcgctcgtacagtggggtgattttttcgtttctcatagctgtacctcctgaaacaaaaatgctctaagtgattgcttcactaaccatgacaaaatcatgattaagaagtcacttagagcatatatcaccggcagccagcttgtacttcttgtactgacggacggcgaagtggttgggcttctcggcttccagtgcatcaaacatcaggtctacggggtttttgaactcctcgtcatcctcccggacttccatggcgttgatgaactcgatgagggtagagaaattctgctcctctaccggggcctcatagtggatatacccaatcagcgcgcaatacagcaaggtctctgctttgacccaaaaatcgtccccggccttgccttcgcctttggtattggcgatcagcgttgtgaccagcttcaagatgtccttttcgctatggatataggcgaaagggttatagtgcattgattttcggaagttgatggtattgaggaccttgatgcggtacggctcataaatgaccttgccgtgcttatccttcatgggctttccgtcctttcccagtttgggtgcgcccctttggagcattttcccgcactccaccaaaatggttcccttcgggtctgtgaccacataagaactgtgcatctgcatcaaattcggtttgagccagaagcgggtcttaccggaaccggagccgccgatcaccagcacatttttgtttctggcggtctttgggtccttggggcggctgttcatggtcaggctttcggttttggtcagaatcacattgttctggaacaccgggtcgatgtagggagcaatatcctcacgggttccccaacgggcagagccatactccatgccgtgacggtacttcttggcgtttttacttttgagatacaccgccagacgcaggccagcaccgcagcacagccccaccagcagatccaacggatgcaggctgggccagaaactttgcagcgccccaggcaggacagcaaacagggaaaggaatttctccgaagcatttgccccctgagccagtcgccatgcctccccaaagttagtagcaaacagccccatcaggagataaggcaggttcagcaaaacgagctttttgatgtcaaactgctttttcatcgttccagctcctttcgcttggtgcggtccaccacggcatttttgatcatctctttgaactgactgagttttgctagcacagacgggcgttccgttttcttggccttcttgacctttttgctggtgtactcggtaaatgcagcggtcagcgcatcggcgtcacggcctttgaaaaagatcaggtacttgggcggggagctgctgcggtctttcttcaccgcataatccacaccatatttccgggcgatcttctcaaattccttgatggaagggtctgtgatctcgatattggagatcccctgattctgaccaatgagctgcttgacggtctgtttgccgtggggtgtcacaggggcgtcacggcttctctgcttttgcagcttcttttccttgcagtgggccatgtacttgctaatggcggctttgagcagcctgccggtgaactttgttccgctgacaaccagcgttaaagtcctgttttccacttcttcctgcattttcatcgcctcctttccacaaaatgtgcaggggtggtgcatttatttctaaggcgggaccaccagccgccggagaaaatagtgatttatcatatcaccatcaggatactgtctcgcagttcggcaaaatacagcttgccttgcggagttatcagcgtataagaaccggtatgtccgtgattgcagtagtcctttacacaaaacagcccttcattggctggctttgcatagggcagtacattgccggacgcagtgcggtacacaaaacgcttttccagaagaaatcggacaaagcggcgttccggtacatcaagctctttggcagtagttctgagattggtgctatgctccaaatcaatgaacaggtcatagaaagcggctttaccctccagctgtgcgtttgctatgcgcagagatacattctcctctcgctcagccagaagatccgagcagagcttgagcagcgcctccggtgaagtagctacttcccatagcttttcttttgtgagataggccccatgcttgcgaatggtaggaagaacctcgtcaaagacccattgctcaaatcgttctgctgatggcaatttactgtggacaatcaaacgatacagatttccttcactgatgaatttagctttctgttcacgccccaaattatcggtgaggtggtaaaacgccaccccatcttctctgcaatgtgtctttagggcgtttactgtatctttgtaccccagcgattttgcaacatcagcgccgcagaacaggtatttcccattttcctcgactattcgaatgcttccaaactctggactattgaaaatttcaatctgattcatgctgtgcctcctttggtgtaatacaaaagcggctgattaccagccgcctgcgtgcatatcgtgatttaccagtgaagtgtagtggttattcatggtggtaggagcgttgaacagcactgcaagcaggtactgcttgatgttgcgtacctgggtggtgttcttttgcagacagtccatgacaaactcgatgtgagagctgtccagcttcaaaaagcgggagcgtacaatctcgtgaggaaagtccgcaccagagatccgggtggtctttcgtttggcacagaccgtttctaccaatagctctacaatctcattcaggtcatccaggtagagaggataacgctgcttcagacagtcatactcgatattctccaaaatcaattcccgataattttctatctctgtgacagacatcgcatcccttcctttccgttccggcggtattgccgccgctgtttcccggaagggaatggaatcggtatttgatccatgagtattttgtttttgggtatttgatttcttagtatttaattgtgttggattttccggtaacggatttaccgctgacgggtttaccgttatcgggttttccgacgacggcttatccaacatcggttctccctcgatgggacgctcaaaaatggtatactcattggctgcgaatttaccagaagcatcagttgtctgtctgcgccgaatgtatccggctgtttcaagctcattgacagcagagcggattgcatctttgctttctcgattgatatagctgagtcctgacagcgtataatcccagtcatcaggcagagataacatctgtgacaagagcccctttgccttcaaagaaagccgtttatcctttagatggaaattgctcataaccgtgtaatcgccagtgcgttctacacgaaaaacagccatttacttcactcctttcatttctcaggtatgaaaaaagccgcaattcataagagaattgtggcagcggttagggtctgtctgtatcttttttcttgcgtcggtaggggcgttttggcattggtggtttatcaaacagatccctttcctgagaaaatggtaaggtttgaaaaacacggtcaatctcggtggattccatatcacgctgtgagcggcaatcttcttgaatagcttctcggatttctcttacagtacacatattcattcctttcctttcgttgtatcggttatgaacgacggtgttttttaggcttgaagtcgagaatatgcccctcaataacatgagcatatctcttaattttgatttctcgacgctgctggctttgcagagctgactgatacccgtcctctgtgagaaaaagcctcatttcgtcaccgggttctccataagcagtagggcgcaagacagtaaactcaatcatccagcaagtgctgtcccaaaatcgctccactgcaagaatgttgtggcctttcagctcccttgctgcaatatctttcataggctctcccttcatcgttcctgatctcgttggcgttttttctgccattgttccagcagtttaataatggtttcctgcattttggccggtgtatagcttttggggaaatactttcgcaaggtatcgctgctcaaggtcactttatccagatcaccctttttttcctctgacatgatggcaagcatcacatcttctgacaatttcccgtcctggctgaactttttcattcgctgagcctgagaaagagaaggggtggcctgctcatagtccattgtttccaccagcatttgctgttcgtccggtttcaaaaaagagagttcataggctggattaaatgcgattttcttttcatccaccatatccaaaagctctggaatcagctcagtcaaacgaacatatcgcattacctgaataccgcttcgttcaccggcttcttttgccacctggtctctggcgctcaacttctgttcaacttgaacagaagtcaggtctgttcttgctccttgatgtttaatggcttccagcttcattttgtaggcaaaagccctttcactggggagcagattttctcgctgcaaattgctgtcaaccataataattgtggcagcatcgtcatccaagtcgcgcacaatgacaggcatggtttcttttccggccaattcgctggctctgcggcgtctgtgaccggctaccagctcataaccgccatcaggcagtggtctggcaatcgcaggaaccaaaactccatactttttgatgctgtctgcggtttctaacattgcatcatcatccttgaccttgaaggggtgatccttgaacggatgcagttcagataggggaatttcctgaattttttccagttgctcgtcttgccgactttcttcagtagaaaacaggtcatctactgaggccagctctatttttttcgcgctgcttttcaagtttcaatacctccttcgtcagatttttgtagccctcagccactttgccattaggatcatgggcataaatgctttttccttcagcactgatttctttagccctgacagaatgaggaatttctgatgtaaacaccttgatcttactgccataggtttcgcgcaggagagcggagatttctttggcaaaattggttcggctgtctaccatcgtcagcagaatcccatcaatttgcagcttgggattgatttgtctgcgaaccttattgatagtttgcaaaagctgctctaaacctttagcgggaagatactctgcctggacggggattataaccctattagcggcagccagtgcattgaccgtaagcatacccagggagggctggcaatcaataaggatatgggagtattgccccttcagcgtgtccagatattgtcgcagaatggtttctcggctcatagcgtttaccagagatacctccataccagatagctggatgtccgcaggcatcaggtctacgccctcagggtggtgcaggataccctcgccgggacgaattggttcatccatcaaaatacggcccatagcgtctgacagtgtaaagggcagcttgtcaggttggggattgcccaagctgatggtcaggcttccctgtgggtctccgtcaatcagaaggactttcttcccagactgagccagaccaattccaagattggcacaagtggttgttttgccgacaccacctttttggttggctatggcaataatctgtgtattcataatttcacctcatttctttctaagtttagatatgaaaaaaagtgcctgctctacctttcctgagaaagataaaacaggcacttttattggctcaatacctcttgtaatgagcctctatgtatggtagactatgtccacgagaccataaatataattaagtcccgacgggaattgaacttttggctaacgctaaaattcgcgcctttgcaaacagagtgcaaacaatagggggctaaaatcctttgtttttgcttgattttgcttgtacgaggtttacagtgaatgtggagaaatgccttgatataactgcattttctttatctccgttgatagggaatatatgcactgggtccatctcctaagcggaaggccagcggttcgaatccgctcaggaacatacaaaaacacgccggaaaccctggtttaaggggctccggcgtgttttcttttccgtttgccaaaattgtacagggctgggcagctgacctatatacagctataaggctacaaatgctgcagttaaattcattttttatttctcttttgccgtacaccttctgcgtgtcagacatatattatcataaaagcaccaactgaggaccattgtatatgaataacaataacccctactctgaaccgttacttaggatgacccaggcagaagacccgattgacccaggtttcacatatcctgacactgaaatgatgcttccgtcccctgacgatgatatcgaccctgatttttcagtcatgcctccttactatccggactaccccgtacgtcctgattatccggtacgccctgactatcccgtccgtccgaattaccctgtgcacccctatccgccatattatcccatcccctgcgtgttctgcaataataaccagtggattcacggcggaatacgcctgttaaacggggccaccgggtataacccatttaccgtgtatatagataaccggccagtattctccgggttggagttttctgaagtgacccagtaccgccagctgtcccagggctaccataccttctccgtcatgggctcaaacggctatgtatatctccgcaaatccatgtatgttggcgacggaatggccaccattgccattgtcaactcctccacaggcctggacctggtatccatccaggatacggcctgccccacggaccggacctctgcctgtttccgggtctgcaatttagcctactacagcgggcccatcaatgcctccctgggcaatatttactttaactcaatcaactttgccgatgcagccagcttcagccggctcagctccggcagctataccctgcgtgtggcccgttccgcccggccggaaaataccctggttaccacgccggtaacactgaatccctcccggatttatacgctctatgtactgaactggaatccttccgtggataccatacagacacttctggtggaggaccggagaagctaatcaacagcctcacagggagaaggatgcaaaattgatgcatccttctccctttttttgtataaaagcctgtatttttcggccctgttcatgataaaataaaggaaagccggcggatgaaacccacgccagatgagagagttttctcttgtgcgaaataccaatccgtcgtatactataaaataatgcgaaaattcaggaggatacagtatggacaaaattaagatgaccaccccgattgttgagatggacggcgatgagatgaccagaattctctggcagatgattaaagacgacctgctgctgccatacatagatttaaagactgagtactatgaccttggactggaatacagggatgagaccaacgaccaggtaaccattgattccgccaatgccaccaagaagtacggtgtggctgtgaagtgcgctaccatcacccccaacgcggcgcgtgtggaggagtaccacctgaaggaaatgtggaagagccccaacggaaccatccgcgccatcctggacggaaccgtgttccgcgcccccattgttgtaaaaggaatcgaaccgtgtgttaagaactggaagaagcctatcaccattgccagacatgcttacggcgatgtttataagggttcagagatgaagatacctggacccggtaaggtagaactggtttacactgccgcggacggcgcagagagccgcgaactggttcacgactttacctgcccgggcatcgtacagggcatgcacaatatcaaccagtccattgaaagctttgccagaagctgcttcaactacgctctggatacaaagcaggacctctggttcgccaccaaggataccatctccaagaagtatgaccataccttcaaggatatcttccaggagatattcgaccgtgaatatgcaggaaaatttgaagctgccggcatcacctatttctacaccctgattgatgacgcggtcgcccgtgtcatgaaatccgaaggcggttacatctgggcctgcaagaactatgacggcgatgtcatgagcgacatgatatcctctgccttcggttccctggccatgatgacctctgttctggtatctcctgacggcaactatgaatacgaggctgcccacggaaccgtacagcgccactattataagcacttaaagggagaagagacctccaccaactccgttgcaaccatctttgcctggaccggagcactgcgcaagcgcggcgagctggacggcaataaggaactgatggaatttgcggacaagctggaaaaggctaccatcgataccattgagggcggcgaaatgacaaaagacctggccctgattaccaccattccgaatccggtggttcttaacagcggggactttataagggcaattgcaaagaggctgtaaaacagaatacagggtctaaaaagacatccggtccgggataggattccctgaccggatgtcttttattctaatccataaactggtccccataaccataatgctccaccacatagtcgatatccttatcgcctctgccgcttaagcacaccaggatggagccctgtctcatctcctttgccctgcgcatggcgtacgccacagcgtgggagctttccactgccggtatgataccctcatatctggacagcttgaaaaatgcctccatggcttcctcatcgcttaccgtgtcgtatttaacccggcccaaatcgtggaggaatgcatgctccggacctacagacggataatccagcccgctggcaatggagtataccggcgccggctctcccttctcatccttcagcataatgctctcaaatccatgcataactcccttttcaccaaatttcatggacgcagcatggtcccccagcttttcgcctcttcccaaaggctccacccctgtgatgtccaccgggtcgtccaggaagggaatgaacataccgatggagttgctgcccccgcccacgcaggcgcagacctcatccggcatcatgcctgtcatttccaggaactggtcccttgcctcatatcccacaacagactggaaatccctgaccataagcggaaatggatgagggcccagggcagagccgatacagtatatggaatccttataattcctggcataggattcaaaggccgaatccactgcctccttcagcgtcttaagaccatgggtaaccggcaccacctttgctcccagaatcttcatcctggtaacattgggcgcctgctttgctatatccacttctcccatatgaatctcgcactccaggccgaaaaatgcagctgccgtggccagggccaccccgtgctggcctgccccagtctctgcgataaggcgcttcttgcccatgaatttggccagcagtccttcccccatacagtggttcagcttgtgggcgcctgtgtggttcaaatcctcccgtttcagatatatctggcaatttccaatttttccggacagacgctcgcagtggtaaaccggagttggccttccctggaattccttgcggatccgcctcagttcattgatgaactgtgaggaatggcagatggtctggtatgcgtctgctatctcctcaaaagccggtatcagctcctctgtaagataagcgcctccgtattcaccgaaacggccgtccttatccggataattctttaaataggttctgtaatccatgtccttctccttagtcatatatttttctatccattatagctttatttcccctggttttcaatctgtatctctgggtttgaacctgcagaatccccgttcatacgcctctgtctccatgggtcttccgtacagatacccctggcctgcggcgcacctgcactgaatcagatagtccgcctgggcggcttcctccaccccttccgccacggtctgtatctttaaatccctgcacatggctatcacatgcttgacaatctgccggctcaccttatcccttccgattttgtccaccaggctcttatccagcttcaggacgtcaaattctatatcggacaggatgtccagattactgtatttggtgccgaaatcatccaggcagatacggtatccccgtttcttgaactcccgcagcgcctgatacaccacatcccttcccagggccccgatgctttccgtcacctctatctccagctgttccggccttacatcatatttctgtacaatggattccacggaatccacgataccctcgcttaatagggtcagccgggaaaaattaaaggacagaatctgctctgtataaccggctctcttccattgctccagcaggcggcagcactcttccataacaaataaatccacatagcttataaggttttcccgttccaatacaccgatgaacctggagggaagcacatccccgccttcctttcccttaacccgtaccagagcctcggcgccagcgcatacgcctgtgtcaaaatacagcttaggctgcagcaacgcacggaattccccccgctcaatggtggaaagcagctcctttataagctccatccttcccttgccgtgaaaggacggcttgctttcataatatttctgcttgtcaatccgcatcagctcacaggcctgcttcacagcccagtccaggtttttctccctgtcatcccatatctttcccactgccgcggacagctggctctgcgcccccagctcctgcaaaagaaggcccgttctctgctcgaattccaccgaggatatatcctccattatgatatcaaattcattgctgttcaggcggaacactctgcggtccggaaaatgcttcttgatgatatccgacacactgcatatgattctgtctccctgctcagtaccctttgtgtcattgatggatttcaggtcgttgatatccaccacaatcacgcccagggaaaccacccggtccgccctgtactgcctgcggtactcatcatagctgccccggttaagcagtccggtaagggaatcatgatatatgctgtaatacaggctttgggagtcctgtctcctgttgatttcctgggcaatgaaatacaccagcatatccatcagcgccagaggccggcggctcttgcgttcaaacatgacaatatatccctgaagccctttgcggctgacaatgggaaataccgacatatctgcgagccgctccctctccatgccctggaacacctcaaaggactcccccagcatgtcctgaggttccacgtagtccataacgccggagggccgcttatggctgagccacgcctccatgtcctgctccagggtcaggcttatcccgggcctgccgtattcatccatgcggcagatgcagctgataccgaaggaatccttatccttcaggaacatccgcatatgggacgccccgtaataatctgccagaatatccatcagacggctcatggcctcctccatgtccggcgcatctgtcatggcatagataccgctgataaccttataggcaattttctgtccatcctcctccccgggccgcggtccccggccttcagcctctttagcggcctgcaggattcgctcagacagcttttcccggcctgccccgcagacctctttgtcctgcgaaaggctgtgctccgtcctcttataccggtgaatatccttcatacagaaaaatgcccgcacatggtccccggcagggtccatatacatgtataattccacccgtacccagcacagcatgtcatgccccatcagacgcctgtattccagcgccgtcctgcattccccgtcatcatacttctgcagcaggccggttctgttaaatgtccgtaaaaattcttccctgtgttcgggttttactgtctcctcagccatcttctgcacaaaacagctgtaggaacagccagcggctgcttcccgaatctcccgccattttccggaggcccctgtcaccctatcctctgtcaggtccgcgtccccgtatgccagcataccctccagcagaaactggtttacacgcctggatttcatatatgcctgctccagctccttctgcctggatatatcctgaatcctgccaagaacaattcccggtaaatcaccctcataagccatgatttccagctccaggctgaaccacccatagtcccccttccggtctttaagccggacctcgcaccgcgcagttctcccgccctcctgtaacacgcggaacgcctgcaggaacgcattccggctctgcggatggaccacctggttctttaccacacactggggaaaatccttaaactgccgttcttccccgtatgtaagcttgcgctccgtataaaccagggctgtcctggtattgatgttgtactcaaatatctcctggccgccaatatacagaggccaccgcatcatctggtccaggatgcccatgttctggtgataccccgtgatgagcactcttccatcctccatctgcctggaccggcctgcgcaccgcaccagcatatcgccccactcaggatgattccatgtatactggatttcacacagcttatccgctgccagtatacgctgcatggcctcgttaacgtacacatagtttccccggttaatccttccgtaccagaattcaaagcatgcctcgggctccagttcctctttaaggcccaaaagccaggccatggtccggtccacatacatcccggcccggctcatgctgcggtctgtaaccatggcccataaccccatctgcgtatgctccaggatatggcctgaccactctgtatcatgaaagataaagcatttccttaaatcactgtaatccatatgtttacctcagcacacggacaagcggcgcccgtccaaatattcagtcccactttattatagcatctctcacccaggatacgataaaaaaatgttttatttcaaaatttcacccggcatccgctgcttcaacgcaaaaagcggtcaaatagaccgctctgcatgaatatatgtattttgttttctccagaaaaatcctcggattatccgggaatctatgaaactgaccggaaggcctcctccaaatcctccaatatgtcgtctatgtgctccgtaccaatggacaggcggatggttccgggacggattccctgctccagaagctcctcctcgttcagctgggaatgggtggtggaagcaggatgaatgaccagggactttacgtccgccacattggcaagaagggaaaacagttccaggttgtcaatgaaggctcttgccttccccgccccacccttgatttcaaaagtaaagattgaaccgccgcctctggggaaataagttctgtaaagctgctgctgaaccgggtcccggcttacacttggatgatggaccgcttccacctggggatgggcgttcaggtactgcaccaccttaagggcattttccacatggcgttccacccgcagcgacagtgtctccagcccctgcagaaacataaaaccgtggaatggtgaaagggtggcccccgtatcccttaagagaatggcccgtatccttgtgacaaaggccgcagcccccacatcctgggcaaaccgtatgccatgataactggggtttggctctgtaagtcccggaaacctgccggaggcagtccagtcaaacctgccgctgtccacaatcacgccgcccaccgtggtaccgtgaccgccgatgaactttgtggctgagtgtaccacaatgtcagcgccgtactcaataggacggacaagatacggcgtggcaaaggtattgtctataaccaggggaatctggtggcggtgcgctatggaagcgattctttctatgtcagcaatatcggaattggggttgcccagcgtctctatgaaaacagcctttgtattatccctgacggctgcctctaccgcctccaaatcggccgggtccacaaaagtggtctttaccccgtattcaggaaaggtgtgggccaggtaattgtaggtgcctccgtaaatatggctggatgatacaatatggtcccctgaccgggccaggttctggaatgtataggacagggccgctgctccggaagccgttgccagggcagccacaccgccctccagctgcgccatcctctgttcaaatatatccagggtaggattggttagacggctgtatatgtttccggggtcgctgagattgaaccgggccgccgcatggtcacagctgtcaaatacatacgacgatgtctggtaaatcggcactgcccttgccccggtggaagggtccggctgctcctgccccccatgaagctgggttgtctcaaatttaaaatgcctgtctgctctcttacgcttctctcccatgatactgtcctccgtctctctattcctactatttctataggtttaattgatagtatcatggtatttttttcctgtcaagaatttatttcaatacatttatataactgcatcctctattcccggccgggcattcttaaacagagccccccttatccatctcaggcattcccggcccattcttatcagaaggcgcacatccaaacatctttttgtaagccctgaaaaagctggagtagtctccgaagcctgccctggacgccgcctctgctgccggcgcccccatggccagttctttcctcacaacagccatgcgcttatagaggatataccgggccaccgtggttcccgtggccctcttaaatacagcagtcagatggttcttactcatatagaaggtctgtgccagcccctccagtgtcagggattcagagaggttctggttgatatagcggatgatttcctggacctgcccctcctttcccctggatgtccctgccgcctccctgtacattgcaaaaatcttagtcaaaagagacagcacccgtgtgcggattgcaatatcctgtaaatcctttccatagcccccgcactcctccagggaatggaagtaccactccagctgaaactgttcctcataacagcaccatcctgtcccaaagggcttcagcaaaagggcctgctcattttcctccagaagctccggtgcaacgtgcagccgtatccggttgtattcatccgaatccaggacccttaacccgtgaaagcagccaggcggtatgataatcaggctccccggcctgggcgtgtaggtcctgccctccagcagatactccacattgcctgaaatcatgtaataaacctcatagacatcatggcagtgcatcctgtactccatatccgcctcgtcgctgcgcgtatgggcatagaccaccttctgcgtcttaaagctctcttcctggtacatggacctcctccttttaaaatccggtttctttcattctaacacagattgtgctgattgcaatatttctttgtcttctgacaatggtttttgcaatatacctgtattataatgtgtcctgtaagcaagagaaacacagcaaataaattgttgcaaaaaccgaaagggccctccccctttcacacattttatccccctttatacgcagtaaaagaccaggcatccccagtgcctggtctttctgtaactgctgctatattgactggctttgatattatctgtaataaattctgtgatgtgctctagggccagattgcccttgctgccttggcttccactacccgcttcacggcaatcaggtatgcgccggtgcgcatagtggcattctgtttctgtgaaatatcccatacagcctcaaacgcagggtccataatatccttcagcttttcgttgacttcctcctcagtccagctcacggactggatgttctggacccactcaaaataagaaaccaccacgcctcctgcattggccaggatatcgggcacaacggtaatgcctctgtcccggagtatttcatccgcatccgcggccactggtccattggctgcctccacaatgatttccgcccggattttatgcgcattggaagcattaatctggttctcaagggctgccggcaccagtaccctggcatccatctccagaagctcctcgttggtaatgcggctcatgccctcctccgtgtaatcctttaacagatttttcctgttaagggaaaggtaatccagaatagccggcacattaagcccctcaggacgatagattcccccggacacatcgctgacagctatgattttcatgccttccctgtgcagcagcttggctgtgatgctgcccacatttcccattccctgaatggccaccgtggttccctcagcagggattcccatttttttcaagatgttcttcgtggtatacataacgccccgtccggtggcctcgttccttccaagcgcaccgcccaggcagatgggcttgcctgtaaccactccgtggatgcagtggcccttcagcatgctgtaggtatccatcatccatcccataacagccgcattggtgcccacatcaggagccgggatatcctgttccggcccaatgagcggggcgatggctgccgtatatcttcttgtgatggcacggatttcattttcagacagctcatttgggtcgcacacaacgccgcccttgccgccgccgtaaggaatgtttaccacggcgcacttaaatgtcatccaggctgccagcgcccggacctcgtcagggttaacggccggatggaaacgtacgcctcccttggccggtccccgggatgtggagtgctgtaccctgtatccctcaaataccttggtggtgccgtcgtccatacgcaccggaatcgcaaccttaagctccctctccgggtatttgatggcttctatatcgctgtccgtatagcccagtatatcggctgcttcctttactacctttaacacattgtcataaggattatatgttttctccatacctgctctcctttttctgcctgattgtttacactgtaacttagtttccctgattcatcactgactcgattcctgctatcttcacgcacagaatgaatatgtccatggcagccttcagttcctccggtgtgggataggtgggcgcaatgcggatattcctgtcctccgggtcttttttgtaaggataggtggctcctgcgcctgtgagcgtgacaccggcctccccggccagctgtaccgtgcgcttcgcacatcccgggagggtgtccagggaaataaaataacctcctcttggatggctccacaccgccagtccggtccctttcagctcttcctccagacggtccagcaccatgtcaaatttgggcctcagcacatctgccagttccttcatatggcggcggatgttctccggcgtcttaaaatactgcacatgccttaactggttcagcttgtcatgtccgatggtctgggaggacatatgtcctttcagctccttcatgttgtccgggcctgaggcaaccagggaaacgcctgctcccggaaacgttattttggaggttgaaaagaaatagtaggccctgtccgggtgtccgcaggcccggcatgcatccaggatgttcttaagggccacttcaccgtagatatgatgtacgccgtaggcattgtcccagaatatcctgaaatccggggcagctgtctccatggctgccagacggtccaccacccggtcgctgtagcaaacgccctggggattggaatgaaggggaacacaccagattcccttgatggactcatcctttcctgccatggcttccaccatatccatgtccggcccgtcctccagaagaggtacgggaatcatctggattcccagctcctcgcaaatctggaaatgcctgtcgtagccgggcacagggcacaggaattttaccggactgccctcatatccgtaatggctccatggcttttctccgccggtcccaaagaggcagtgaaatgcaatggtgtcaaacatcaggttcaggctggaattgccccccatgataatctggtccggattcagccccaaaagctgtccaaacagacgcctgcattccggaatcccttccaggacgccgtaattccttgtgtccgtgccgtcctccagcacacagtccttcggaaactccaacaggcccatgttcatatccaactgggctgctgcaggctttcccctggccatattcagtttcaaattcagtttcctggcttcctgaaactgtatggtaagctcttttaacatatcatgcagttcctgtctggaatattccgttacatggttcattcattgcctccgcatcaaacatttgtcagatatatttgttcttgcctttattataaaaataacctagaataaaaacaaatatttatatttgaataaaacttataattaaaaacttataggaggtgcagctatgttcagcgggatgaattatgtgtatgaagtctataaggaacagagcttttccaaggctgctgagaacctttacatatcccagccagccctcagttccatgattaagaagatagagacaaaggtgggaatgccgctttttgaccggagcaccagtcccatccagctgaccgagtgcggcaggaaatacatcaagacagcggagaaaatcatggacctggaaaatgaatttgcctactatgtgggcaatctccaggagctgaaaaccgggcggctgtccgtaggcggcacctacctcttttcctccttcatctttcctcccattattgataaattccgcagggcgtatcctcacgtgaagctgaacctgttcgagggccacacccctttgctggagcagaagctctttgccggggaactggacattatcattgacaattatctgctggatgcgggcatctacgaaaaggagcggttcatggaggaacggctgctgctggccgtcccctgctcctttgacagcaaccggcgtgcagtgaaataccagctgaaggctgccgacataaagcgctgcctccaccagaacgacacatttccggccgtatccttaaagaaattcaaggatgagccctttgtgatgctgcgttcccacaacgataccagggaacgtgtggacgccatactgggccgggccggaatccagttaaactacaccttaaagctgaaccagcttttaaccacctatcacctgacagagtacggcatgggcgcctcctttgtcagcgacaccgtggtcaagtgccttccggaaaacccggatatcatatattataagattgacgaccctgaggcggtaagggaggtctacctgtattacaaaaaaaataaatacctgacccggagcatgattgaattcatcaaaatggccattccgggcattgaaaaaaactctgagaaatatctataagcgtatgcttataagtgttataaacagcatttttgtcaaaaaaaaaacacatacgggggtaagaaatatggtaggatggccagaaatccttaagaaggaaaacctgacaagagaagagaaaaaatgtatctgcaaccggctcatgaccacggaaagccatatggagcagctgatactgaagcatttcacggaggaggatttccgccgggtctggatgcgcaagattggaggcggcgtcatcggcggaaaggcctgcggccttttagtggccaggaagctgattgagatgaacatgccggaatacgccggacatgtggagccacataactcctttttcattggcacggatgtgttctaccggtatctggtgtataaccgctgcgcggaattaaaggccaggcaccggctggaaaaggaacattttaaggaaacagaggagctgaccagacggctgcgaaacggctcccttcccgaagatatccgggaagagctcagcgacatgctggaccactacggaaccacccccatcattgtccgctccagcagcatcatggaggacggatacggcaatgcattctccggcaaatatgaatccattttctgcatgaatcagggtaccaaggaggaacggatggaggaactggaggaagccatccgccgggtctacgccagcaccatgaatgaacaggccattgagtaccggaggaaacgccatttgttagatgtggatgagcagatggccctgctggtccagcaggtggcgggccagcagtacggtgacctctatatgccggtggcagctggtatgggctgttcctacaacccttacaaatggatggagcacttaaaccctgaggcaggaatgctgcgcatggtcatgggattaggcacaagggcagtggaaaggacacccggcgattatccgcgcctcatcggcctggacagggcccaggccaacctaaggaccaccctggctgaacgccacaaattctcccagcgcaaggtagatgtcctggactttggcactaagacgctctgcaccaaatccctggaaaaaattctggacctctttcccaaatggcagaaaaaaatggtcctcagcagggacacggatgccgaggacctgctggccgagcgccacatttacaggaccatctattttgcggactgccagggcctggtggacaacctggagttcatacgcatgatgcgctcccttatgaagatgcttgaaaaagagtatgagcgtcccgtagatgtggagtttgccgtcaccagcccggaggaaggcgtgtggaggctgaacctgctgcaatgccgcccccttcagaccgccaaatccgagcaggtacatataccggacggcgtggaccatgaattcctctttgatgtccgcaggacctccatgcgccgttccaaggaggagcgcatcgactatattgtgtgggtggacccgcagaaatactatgaatatgaatactcccggaaaccggatgtggcccgcctcatcagccgcatcaaccagcattttgaggacacggataggaagctgatgcttctggtgccgggccgtatcgggacatcctccccggaactaggcgtacccgtggtctatgcggaaatcagccagttcagcgccatctgcgaggtggcctatggaaaagccggctaccatcccgacctctcatacggcagccacatgttccaggacatggttgaggcggatgtgtattacggtgccatcaatgacaacagcaagaccaggctgtaccaccctgagcttctttccaaatacccagaggtgttaagggacatcctgcccgatgaatcccaggagctggctgacatcgtaaaggtccatgacataagccaatccagggccaccctgaccctggatgcccaggagggccgggccgtgtgccggatacgcggcgcagagcaggaatgatttcccgcctgcaatcatacgttttcccgcaatgtatacccgccttattatcacgcgggatatacattgcgggaaataaattattttttaccattgacagacaccaaaaatcatgatatagttatctcatattttttataagattttgatttcacatgtttttgtaagtcattattcctatgatgatttacaaaaatatgtgatttttttatttttatcgaaaatataataatattatatcaggaggtatctttcatgaataaaggtacagtaaaatggtttaactctcagaagggctttggcttcattacgaacgaagaggatggaacagatgtgtttgttcacttttccggtattgcttccgatggctttaagtcactggaagatggtcaggcagttacgtttgacatcacaaacagccagcgcggattacaggccgttaacgtttgcggcgcttaatcaccagcgcattaaggggaccgtctctcagaggcggtcctttttgtaattatcagctgcaccggatatgggtccggaactgttaatgaactatgtatgggtaccaggataagcctgataccccaatgccgcaggttactgctgtttcacaaactgcttgtcaaactcagcattaaaataataaaaattcttttcatccagcttggatttaatcttttccagggcctccccaaaccgttggaagtgtacaacctcacgcgcccgcaggaacttaagcggttcacgtacttccggattttcaattacacgaatcagattatcataggtggttcttgccttctgctctgcagccaggtcttcatgcaaatctgtgatggcatctccctttgactggaattcacaggcattgaaaggcacgcctgcagcagcagtaggccatagtgctgtggtatggtcaatataataagcagcaaatccatctgttttagcctgttcaggcgttaggtttttggtaagctggtatatgatggcgcaaatcatttccaaatgagccagctcttccgtaccgatatctgtaagcaatccgcccacttccttgcatggcatggtataacgctgggaaagataacgcatggaggcagccagctccccatccggtccgccgaactggctgataatcaaggaagcggtcttcggacaggttttagtaatatttacaggaaattgaagtcttttctcatacgtccacattatacggcacctccttcattatcccagggaagaggtccgtcggaccaggtaaaatgcttctgtcccgggtattttgtcttggtttctgtcttgttatttgtgtcaggacagatacagttcagggtcaacggctcatattcctttgcaaaggcgtccagcagctgttttctctggttcagggcctgactgaacgcatccagggcatccttatccagaggatgggtgtccagatacaggttcaggtcattgactacgaaactggtttcattaatctgtttaagaagctggcagcggtcaggcatgaggttcacctcctactaagaaaaatggcaaatccagacatggaaaaatggttccctgtttcagggccttcgacggctcatacggcgtctcccagggctgcatgggaacagtggctatggccagagaaagtccgggtcccggggccggaagcttatccccgcatccgcaggatgccggagccggcttgcaatcacataaattcataagaacactcctttcatcatgaacttaacaactcgtgtccttattattatcccttggtgccggttttttaccttgccaaaattctgtaagataatccataattttttcaaaccgccagtttcatatcctcctctcccggccgcaatatgtatgctggtattctgactgcatatattaagaaatagacaatatgcaatttttgatttacaataggactttatgcattcatcttactgaacattggaggttttacgtgaataacccagctgacactcaaagggactcctggaaaaccaattgggggttcatcctttcctgcatcggctctgctgtgggcatgggcaatatatggatgtttcccgccagagtctccaaatacggcggaggcacctttcttctgccctattttttctttgttatcatcatcggtctgtccggcgtcatcggagagatggcctttggcagggccgcccgctccggtcccatcggcgcctttggccaggccacgcagagccggggaaaaggccggcatctgggtgaagccatcggctatgtcccggttttgggctccctagccctggccattggatattccgtcattgtaggctggatactccgatacagcattggctcctttaccggttccacgctgattcccggcgatgtggaaggctttgcccttgcatttaattccatggctggttcctttggcaataatttctggcagaccgtgggcctggctcttacctttatcatcatggtcctgggcatttccggcggcatagagaaaatcaacaagataatcatgcccctgttcttcctcatgttcctgggacttgccgcctacatggcgttccagccctctgccgcggagggataccgctatatcttccggatagacctgaagggtctggcagaccccatgacctgggttttcgccctgggccaggccttcttctcgctgtcactggcaggcaacggcaccttgatttacggttcctatctggatgaccgggaggatgtgacaaacgcagcatggaaggtggcccttttcgacactctggcagccatgctggccgccctcgtcatcataccagccatggcaaccgctggttccaggctggatgaaggcgggccgggcctgatttttatctacctgcccaacctttttaaatccatgcccggaagccgtattctgattatcgtattctttacagccgtattgtttgcaggaatctcatccctgattaacctgttcgaggcccccatcgctgccctccagcagcagttcaggctcagcaggagaacatcggtcacagtgattgctgccgcagctctggctgtgggactgtgcatacagggtattgtatccggatggactttgtttccatttacatctgccctctcggagccggtttggcaggcatcatgtttttctgggtacttggggagaattatgtgaaaaaagaagtggaaaaaggccgtccccggccagtgggtccctggttccgtttcatgacagcctatctgttctgcggacttacggttgttgtctttgttttggggattgccttcggaggaatcggctgagttcttgacgtttattcccggaccgtagtataatcatatcaatgatacatgtgattccctgtcacctgcaagctgacagggagtcttcttttattcacgaaagacgaggtaaccttatgacatcttcatcatctcacgaaaatccattgggcgttctgcctgtaaaccggcttttggtccgctttgccatccccagtatcatagccatgctggtcagcgccctgtataacattgtagaccagttttttataggaagaagcgtgggcatgctgggaaatgccgccaccaacgtggcatttcctcttaccatcacctgtactgccatctccctgatgtgcggaatcggcggcgcagccaatttcaatctgtcccttggcagcggcgaaaaggaggaagccacccggtatgcgggcaacgctgttttcatgctgtttgccattggggctattctctgtctcacggtcaggctttttctgaagcccctcatgattgtctttggagcaaccccggatgtcctggactattcactgacctatacaggcatcacatcccttggctttccatttctcatcctgaccacaggcggttccaacctgatacgtgcggacggcagccccagattctccatgatgtgcaccctgaccggcgccatcctcaacaccatactggaccccctgttcatcttcggcttccgcatgggaatggcgggcgctgcactggctaccatcatcggacaaatcatatccggcatcatggtcatcctgtacctgacacggtttaagaccgtccgcttgtccctcggctcccttacccccatcccatcccatataaaggccattgccgccctgggcatggcccccttctttaaccagatggccatgatggtggtacagattgtaatgaacaatatcctccgctattatggcgcccagtcccattacggcagcgaaattcctctggcctgcgcaggcatcataaccaaggtaaacatgatattcttttccctggtcatcggcctgtcccagggactgcagcccattgtcagctttaactacggcgccaggaaattcaagcgggtccgggaggcatatctaaaagcagtgctcattgccaccaccatatccgccatggccttcctgtgtttccagctgatacccaggcaaatcatcggcatctttggttcagggagccaggagtactttcactttgcggaacaatacttccgcatcttcctgttcttcacctttttaaacggactccagcccatcactgccaattactttacatccatcggaaaggctgcaaagggtatcttcatctcccttaccaggcagattatcttcctcctgcccctgattgtggtgctgcccatgtttttcggcattgaaggcgtcatgtactctgcgccggttgcagaccttatggccgccctactggccctggtatttgtcaccagggagctccggaggatgcggttggcggaagacgggatggagggtaaggtgggtattgcggattagtcccggctcagatgtccttcattgcccggataaagaaatcctcccggccgaagtttccggacttaagaaccagttccggaccttcctgccccgcaggatacatgaccgggacgcccggggcaatggattttccgatataaaatgtatgcattcccagtttctgcatgactgcgcctgaagtctcccctcctgcagcaatgattcgttttcgtccgcattccagggcataggcggctgtccgggccaatatatcctcgttataatgtcccagaggcggaaaagcttccttccattccgcttttatatgatttacttcatcaggcggtgccgaggtgtaaaccaggaccgcctgatttttgttatcatccagaaacgctttgatatggtccattgtctggatgccctgcacaaactgcagcggatggatgcggtaagaaactcccccctgtgactcataatacctgatttgttccctggtggcctgtgaacagctgccggccagtatgattggggctgaacaaagggagggattaaaccttttccttccctcttccggttcccatgtccgggcaatcatcttaagcagaccggacccccctgacaaaagcgggtgattcctgtatttgtctgcaatcatacttccgtgtctctcttcataataatccggtatgagataataatgccccgggtccccaggaggcctgaactcccgttcaagggcaccctcatccagattataacagggataccggctctgtctttccatcaggcgctttaaccgggaatccctcattgggttaaggggatggtccctcatggaactttcctccagcagaaccccattgacatacagctttccatccctcacgcttctcccgttttccaacagcgcagggcataaaagtgtgtatggtatgttccattgttccaggacagcatccagaaccggtcctatatttcccttttccgtggagtcaaaggtggaacagtatttaaaatacagcatacgtgccccgtgggctttcagccaggaaaacgcagccaggctccgttccactgcctcacagggagggcaggtacgtgtcttcagtgctatcaccactgcctgggccggcataatatcctcattctccccctcaggtatcccattgctgagaatcaccttggcgcctcctgcctgaaggaaggaggcagcatcggcggcccctgtgaaatcatccgccacacatcctaatatcatatctctgtcctcatttataattccttcagtgctgcagcagctgcctccactcctgagtccatgctgctcagaattggcttggaaatgtctgacagacacggaatcaatacgctcatgctggcctgcgccagcaccagaacatcatactgctcctgggtatcacgaatcagcgcctccagtatctgattatgcttgtcctggttcttctccgccgtcagcgcctcaaaggcatcggaggccagataggaatccactgccacatccttttccgctgattcggcaatgcgtcttatcagtcttgcacttggctccagcgtggtcttgaccgtaccgtatacagctattttatctcccctttccacagctgtacgcgccatgggttcatcgattttaagataaggaatcgttagcagcggtcttatgacatccacgccttcccccacagaggagcaggcattaagaatcagctttgctccccagtcctgggcttcaaaagcatatgtcataagccgccttgtaacctcctttgtcagctttccctccctcttcacatcattcagaagactgtcgtccacaatgttcataacctctgcatccggcgccagcgccttaagcctgctgttgataccttcgtaggtaacggctgttgtatggattactgcaacctttcttcccatatgctcctcctgattctataaaactacatttcttcttgccagtgactttttctttgccatttccatataatcctccggcagcttccttacctgccgtcccgcgcccagaattgccagatacatctcacaggccctctccacattgtcgctggatatcatggcatcctccatggtaagtccggtgccaatggctccgtgattggccatgagcaggcctgcatttgttccaatggtattccttacatgggcagccagttctgcggaacccggaggcgcaaagggggccaccagtatctccccacccaggtacaccacaccctcaatatcaatcaccggcaccttatgaacaccgtccagtgcgctgacagccgtggcaaatttggaatgtgtatgtacaatacagttcacctccggccgttcccggaagattcccagatgcatgaaacattcaatggaaggtttatagggacccgacactatatttccatccatatcccccactgccaggtcctccggcttcatggtaagatacggcctggctgaaggggtaatcacaaacaatggctccccttccaccctggcgctgatattgcctgctgttcccaatgcatatcccttatccaccatggtcctgcatccccacatgacctgctcttttgctttttgtactgcttcctgtaacatataagtttctcccctctttgattcatattagtttcatcactgtttactcaaatatatttccgtatcagcctcgcaatttcgtgtacatccccggccctgcgcatggcatttatattaccctcgtcctccagcaaatcaaacagctgataaagcgccggcagatgccctgtcttatccggcgtggccagaaccacaataatatcggcatccatatatccgttaaaggacagcttttcaggcagcctaagcaaagacattcccatgcagtacacgccgtcatccacgcccgcatgggcgataatcacgccatctgcaatcatgatgaaccgcttttccgtctccaccatatcgatggccctgtcaacataattcctgttaatgaatccattgtccagcaaaggcgctgacgccatccggattgcattctgccaatccgttctttcctctgtaatctgaatccgttcatccggcagcagaaagggcagacggctctgcagttttacctgtccctctgatatccgtatattttccagtaccttttccctgaatgatttcttggcaatatcattggcaaagggaaataccacaaattgtttcttgtctgtctccagccttacggtagaaaacacaatctggaaatccttatcatattcgtaaaagtcccttaaggacaggcactctaaaaattcaatctcaggcagaagctctgacagcgaaacgaaaaggtactgcgatacggtaagcccgttggtacacaccaccactgcccgttccttttcccggacctgtatcagcttcccctccttatggagccaggatgcaaagagaaccgtaatatacacaagctcagggtccggaaatgtacatttgaggtagatttcatagggcctcactgccctgcgcacgatttcatggagatactggtatttaggcagtatcatatccgtgatatcaggctccacatgatatccataccatatccggtacacagccggcttcatgtgctgatacaggatttccagaaattcagcccttccgtccaggcggacacagctgatggactcaaagcgttccagcatatgcattcccgcctccctcaaaagctccaggtttcccatatcttcatgggtcctgttatggacctttgaaatctgtatctggactgcaaaataaacaatttcattttcatcctttattccgtatatgtccgcaaacgcagctaccacggaatactccctggtagttgttaccagacggtactggtccatggcttctatggtcttttgattcttaatcctcagcatggtaaaataaaaaatatactgaagctccttcagccgttcatctgtaaactgaagctgaagcttattttctatctcttcaatattgtccttaaggtcttctgcctgtgcttcctctattgcatatacccggttcaggttttcctcaccgcccggcatgtttaaaagctttctgagagcgtgggttaaaagctctcttttatggtattcgcttccgtaaaggcggtatccttccttcctgttatacgccagctccaggctgaatttattaatccgttcctgcacctttttcaaatcactgagcagggtattcttactgatttggagctcctctgtaaaatggtaggtggaaagctcgtcctcatggcacagcagcctgagctcaatccaatacgcccgctcttcgtctgaataagtataagaagacttggtgaccgctgcctctttggtggaataatgctcagccaccggaccgggcaccatgaagtacccggtcttcagccgtttaatctctggatggccgttatccttaagatagtcattgattttgtcaaagctataactgagctgctttcttgtaaggcggaatttatcctccaggcccttgcctgtagcggatgtattattcactatttcctgaaaaatcatataacttctgctatccagatacacgatatcacctcgtcaatttgcttgcttactgtcctgcctttgcattctcagcctccagagctgcatcttccctggcctcacgcattaaatcacggtagtataatataaacccggccagccagactgcaaatataatcaaaggcacaaaattcccctttaagaacatgaacagatgtgaaatggaatacgtaaatacaggaccgttaatcaggctgttgctaatcagttcacctgcctggaggtcaatactgcctgttgctatggctaactcagtcataaacggagcaaatgcagtccccacccacaggaacacgggcgctccgataacacagagaatggacatctggagcaggtttccccttgtcaccagaaatgccggcagtgccagggatgcgctcataagtcctgcaaaaggaaggattccattgcccggcaggaacatggaatagaccagcatgaacggaatgctccaaagaattgccagccatatctcattacagccccccaggataggccagtccagccccacaatcagggtctttccctcaaacttcttattcatgaaagcgctgaccgcctcggagatgggagacaatgcctgcataaaatatttggctaccacagggaacagtgtcatggcggcggcagccttgattccagtggtaagaatctgggccagggaatattttgccagaattccgaataaacagcccagcaaaaatcccattacgtgattttctgcaaagatacccaccttatccttcagcatttctgtgtcaaattccctgtttagccctggaatctttcttaaaatcagggcaatgggatataggatggcgccgaaaaacaacgttgcatgggtcacggacacaccgggaatacctgtcagcttctcaatacggtgctgatgcgcatccgaagatttaagttccagtataatctgcacagccgcaatcacaaaggccagaatcacactgtgggtaatggataccacagcaactgccgtaaatatcttaagccatacattccataagtcagcattgatggtatttgtcttattgagaagtatcatcaccacattgactgcaatcaaaagcggaaacatgagaaatgcatagggccatgcccatgatatggtagccatggtgctccatccgccgtcaacaatgggcagtgagattcctgttgaggtcatgatggcttgggccgccggggttatgctgtccttcataaaggatatcagcaggttcatgcctgtaaacgccacgccaagggtgataccggacgaaatagcatcctttatcttcattcccaccagtatactgccaataatcattatgattggcacaaatatgggagcccccagtcccaaaaagaagttgacaacatttgttaatacttgcatacctttcccctccttctacatatcagcttttgttgaccgcatcaatgagctttttcagttcgtcctcctgcctgacccctgtcaggaacgcgattccgttaataactggcaccggatattcctttaccgtcttagtgatggatatataagccacacagtcttttatatcccggtccagggacttaatattgaccgcgtccaccatggcgtccacctttctttcttttaacagacggtttaccttgctggcaactgcctgtgatgtagcaactccatttgcacatgccactatgattctcttcatatgttcaccctataccttccattgataataccagattaaaatatgtctctgccgttgcagcctgccgcagcctttccataaaatcagccctttggcaattgttcaccagtatctgcagcagttccacatgggcatctcccacatcctcctgtttaaacccaagcaggaatacaaaccgcaccatatggactacctcattggcagccatctccctccatggaatcggttccttcaggcggatacaggcaatgaatgcgttcttaatgcactccgggtccgtatggggtatggccactgcgtacggctctatgggaagggccgtaggatattccttttccctttcttttatgctttcaaggaaatcccctgtcacataccccaattccataagctgcccggacatgacctcaaataattcgtcagtacttctcacatccaaatccagttgaatcaggtccttgtatactatatctcccgtcatgatttggtactccttattaattaatattaaagctacacgcgcgctcatgtatcttctccatatctgcattataagggtccggcattgggatttcaatttaaatagggtccatattttgtgcaatatgatgctcattcctgtgatgcgcaattattttatacataattgtgccttattttcactgttatacccggatggtgcggcattatacacaaccgtatccctgttaactgaccggaacaacagaccgcttcatggttataaaaaaagaaccctgacaatggttccttccaaaaccgtcatccggattctttcctattctttttccatctgctgtcttatattctgttccggcctcaaacccagccatccatcacatcaatggaaaacttaaaatggtcttccggcatgccctgttccttcagacgcctcctgatggtcttcatataatggtttgatattgccctgcatatattctccgtgttcccggtgcggcacacatccaccagctccttatggattgggtactggcgttctatcatagccctgctgtcaggattgcctgcataataattaatggcattcccataatttaaatccgtccatcccttaatcagccggggcagaccggtggaccggataatggcctaatgaaaaccttgttttttatgcactatttccaatttctgttgatattgctccatagcgccctaatatgttccgcaggatttcccatgtctccatttccgacccgggaaattccgacatgcccaacaggctaaagcccatttaaaaaaattccgcagacaaacttttttagcctgcctgcggaattcattgcgcatactctgttcctattctattacggctgcgtgataccttacggactacacaataccctgtcccagcattgcctcaaccaccttctcaaatccggcaatgttggcgcctgccacgtagttgcctgcaactccgtagcgctctgctgcctctgatacctttgcaaagatatttaccatgattgtgtgaagcttatcatccacttcctcaaaggaccatgacatccttaaggagttctggctctgctccagtccggaggttgccacgccgcctgcattggcagccttgcccggcatgaagagaatcttcttctccacaaacaggtcggttgcttccctggtagacggcatattagcgccctctgccactgcaaagcatccattggcaagaagtgcctgggcatcgtctaagttaagctcgttctgggttgcgcatggaagggcgatatcgcaggggatgctccagattcccctgccctctgtgtatactgcggttggaacctcatccacatactccttgatgcgtcctctgcgcacttccttgatttctttgacaatatccagctgtatgccgtccttgtcatagatataaccgttggaatcgcttaacgccactacctttgctcccagctgctgtgccttctcggttgcgtagatagccacattgccggaaccggatacaactacggtcttgcctgccatatccttgccattgtgctttaacatctcattcagaatatatacaaggccgtatccggttgcctgtgtcctggccagggaaccgccgaaggtaagtcctttgcctgtaagtacgccctcatacaatccggtaattctcttatactgtccgaacaggtatcctacttccctgccgcccacgccgatatctccggccgggatatccgtatctttgccaatgtggcggtacagctctgtcatgaagctctggcagaaggccatgacttcacggtctgatttacccttggggtcgaaattggaaccgcccttgccgccgcccatgggaagtccggtcagggagttcttaagtgtctgctcaaaaccaaggaacttgaggatgctctggtttacggatggatggaaacgcaggccgcccttatatggcccgatggcgctgttgaactgtatcctgtatcccttgttcacctggaccgctccgttgtcatctacccatggaaccctgaaagaaacaacccgttccggctccgtaaaacgctcaaggacaccttccctgcggtacttttcttcattggcatcgatgaccagctttaaggaatccaatacttccttgacagcctgatggaactccggctcacccgggttctgtgctacaactctctcgtaaatctcatcaacgtatgacatttcaatcgacctcctggatttttgtttgtatagtgtggggatgctgtgccggtagtgggtccggcacagactttagaaaaagtatagcaagttaatatgctaaagtcaagaagtatgtaaaccgattttaccgcgggtttactggctgtttcctcattttcctccttaaaacctgcctgaaaaacccttggactccccgggccggataccgcttgcttcagtttaatcctgtacacctgccagctcagccagctgctccagcacacctttgccgccgttaagggatatattgcctaccttgtcgcagattttctccaggtactccatttcctttaacttgaacagggtatggttctcatccatcagcttcgcggtgttcaaaagacttcttgtggaagccacctcctccctccgcatgatgacattggcctgggcctttttctctgccagcaggacggtattcataatttcccttatctctcccggaagtataatgtccttgatgcctgctccggttatctccacacagtactcctcctgatactcctttaacttatccagcacaaaccttccgatttcctccttttgttccagaagttcatccagtctgtaccgtcccacatattcccgcagcttcagctggacatatgtataaagctgggaagccactccttccacggtctggaccagtttctcaggattggttatccggtaattgcagatgacatttaaccgcacagccaccttatccgcggtgagaatttcctgaccggagatgtcaagctgctgaatcttcatattgaagattttgcaggtaacttcccttccgtaattccagaagtagtatgacccggtacccagtatcttttcatagcggttgtcaaaatacagaagacctgtctcaccgtcctttataactattttcttataatatttggcaggcatcaggtccatgtacatcctgggaagggtatcctccatatatggcttggttatatcaatgagctggaattcatttttctcaaatacattccagtataaagtctcaggctttgtaatcacttccctgtaggccctgttcacaaaccgcagggcaatgcactcgtccggcagtactgcctttactaccctggaggcaaacttctcgttcttcataaggatttcctcgggtatgccgcaggtcctgacctcccctgtcataggaacagtctgcacctcatatcccagcatgcccaggtaagaatactttcctgctgtcagcagttccacgaaccggccatccttcatcagatagccgcattcctgctctttgattatatatttctttatcatcatatctgaatccctcatagtttgaatctgcggagcatttatcatacattcaaagccccgctacaacgaatcacacagttacattcatttgttggaaaaggcggctgccttgctccgtcctgctgctgcgggcttctgcttaagcacattccggcagggcattctgtcccttacccggaacaggtctggaatacgctgttacacgttcctggcccgttccatccggacgggaaacacgttataagctgatgcttccggtccggcccgttttgtgcggtatccgcagttgcactgggctgcagaaggactgcctttccccgtaaccacaggttcggcaggagccaaggcatccctttcccttcctggagacatttggttatgtcatcattttcaatgattgctataccaacttagctacgtgttctcttacacggcgggagtcgaacccgcgacacatcatcctaaaaggctgcagattgccggcataccactgaaccaaaggccgggcaccggggagccccaggaagaaagctccgcctcttaaggcaaactgccagtatttatgtagggcaggtgtcccgtccacctgacgggccctgcttgtttttctttgaccccatagcgcctatggggccttaaccctttaccacgcctatggtcttaagacgcttcacaggcaccaccaggtcctgctggttatccataacttcctcaatattcttataggcaaaccggctctcctccgccacgtcagcctttcccttctttccaagaatcacaccctgtttctgtaaatccagaatgacctcctcacaggaaaatgctgccatggctccttttctggaatactgcctcccggctccatgggatgaggagcaaaagctctcaggatttccttttcccataaccacatagctgtaagaacccatggcccccggaatcacggctaactcgccgctctgggcgctgacagcgccctttctgtggacccatacatcctttccgtaatggttttctaaggaagcgtagttgtgatggcagttcaggtcatgggaaaattccaatgaaaatccggtatatttgccaatccacttctccagaatggcttttacagccagcatcatcttttccctgttttctttggcaaaatccatggacagctgcatccagctcaggtactgtttcccctccctggtatccacaggcaggaaggccagcctgtattcatccggcaccgcgctgaaccatgtctggtttaactgccttgccttatagtggaagtaatcacagaccgcttttccgaaatgccggcttcccgagtgaatcatcacagccagataaccggcgtcatcttcctggagttcaataaaatgatttcctccccccagtgtgccgatttgatagtatcccgcctccagctgtcccaagagctccccatcctcctcataccggtccatttcttcaaacgcgcagtccatggtatagctgggcatcatggtcttatggtgcgcaaatcccaccggcacattgcgcataatatcgcctatgatggcctggataagggagccgttgcctgtgataacctctttaatatcagccaccttgatatttgtctccgtataagccatgccgcagccaatgtccacgcccactgcattgggaattaccactccctccgctgcaatgacgccgccgataggcattcccttgcccgcgtgggtatccggcatcagactgacccatttgtgaaggaaaggcagctgtgaaagatgatatgcctgttccaggcagctgccctccaaatccttacggtccttcagccatacccttaccgggaccttcatattttctttctcatacatcacaaacatatatctcacatcctttcgtcttcgttttgtacgtctgtctcaccgttcatatatttgcgtatgtatcttaactacatgcttatgatacatgattttcaggcgggtatcatttaaaaaaagttgcgaacttccattatttgctatttatagaaatttggagtatgctgtaagaacagggaaaactgcggtcaggtttcagaaggcagaaataaagcggaccagctgttataaccggattttatattagaaatacatcaaacatttacggacaggaggcaaccgtcatggctgaattccaggaattaatcaaaaactttgaccgcatccgtgactatatgcggcaattttacgtttacgggttcaaggtaagaaatgatttcagtgaaaagagctccagaacctatgacaatgaacgccgccgcattgaaagctggctctcccggtatacaaaatccgattacacctccaagggaaagcatgtttacatcaatgtggacagcaagaccattccccagaatcccctgtacgctgcctggaagtccaagagctttacagacaatgacctgatgctccatttcttcatcatggaccttttatgcggctgtacagagggcttgtcagccagcgcagtgaccgacctcatctcccgaaactacggggttgtatttgacacccagaccgtgcgcctgaagctgaaggaatatgaatcccttggcatactggtttcccataaggaaggaaaaattctcttctatgcgctggctccccttatgtccatggaaacagaacccggcaaaacagtgtctgacgggacagcggacgagaaacatgaattatggcagcgcctcatcacagcagtgaaatacttccaggaggcagccccctttggcttcataggaagcaccatcctggaccgtcaggatgcatgcaatgacctgtttcagttcaagcaccatttcatcgtacacacactggaggacggcgtactggcctgtatactgaccgccatacgggaacagcgtctgatttgtttcgaaaacaaaagcagccgcagcggacagacctccaccatgtcaggagtgcctctgaaaatatatgtcagcacccagaccggccggaggtatctgtgcctgtatctgccccagcgccgccgcttcagcaactcccgtctggactccatcaccagtgtgacccttttggagccatgtacattttacggggaattgctccgtgatttggaaaaaaacaaggataaatgctggggcgtgtcgtttggaggcggcgcaagccgtatggaggaggtctgcatcaagctctacatagacgaggaaaaagaaccctatatcttaaaccgtctttaccgggaaggccgcgggggagaggttctgaggattcgcgaaaaccagtttctgtacactggtacatttttcgataccaacgaaatgctgtcctgggccaaaacctttacaggccgtatcctggacatccagggaacgaacctctttgccatagccaagataacccgcgattgggaaaagatgtatgagatgtactgcaggaatgaggagtaggaaaccatggaattatttcacaaaatctacagctgctattacaatgtagtccgccacatactggacagagccgggcgtgaccccataaccaggcaggacatggaggatatctgccgtgtctatggtttccaggaaagctccctgtccattattcccaaactgacggacggcacatgggcccttctggatgagaaggacaaacatacctttacgtcccggctgggccatgccgtcccggctatccctcttacgaatctccaaaaggcatggcttaaatcccttatgcaggacccccgtttccggctgtttttcactgaccgggagataggacttctggaccgtgaattaggcgcctgctcctctctttaccaggaggaaaacttttactactatgaccgctacagagacggggattcctatgcttccggcgactacaggaaacatttccaggccattcttaaggcgctcagggaggaacgtatccttctggtggcctatgagggaaagcacggccgtgtccactcctttgaaactgcgccttaccagctacagtattcctccaaggatgacaaattccgtctctgctgcctccagctccaccgggaaaccttcagccgcaacaccatactgaacttaggccgtataaaggactgccacgtgacctccaggccatgcccgccggacttaaaagcccgttcattccaaccggtccagaaggctgcaaacccagtggtactggaaatcagcggtgagcgcaactcactggaacggtgcatgctgcattttgccaactatgagaagcacacggagtatgacgaggataagaaatgctgggtctgctccatttactatgatttggcggatgagacagaacttctcattgatatcctatcctttggacctgtggtccgcgtactgggtccgccctcctttataaggcagattcaaaaacgggtcaggagacagcatgagctgctctacggggaaatcacgtaaaaacagatacaatataagaaataaaaaatggatgctgtcctggcagcccgggtgttgttttatacacccggaccgccggcagcatccgtttcgtttaaagctccctgttttcatttaaagctctttacttcctctaaagctccctgttttcctctaatcttaaaatcaaattcttaatcagttcatccttactcctgaattccattctgacacccgtaatataccggaaggcttcctcccattcccccatggaataagatgatatgctgaccgttcgaacggcatatataatatcgtctatataaaacggactgtgaaggtccgaaaggtactggcagcctgatagattctgcaatctggccaacagccccccctgggatttttctggcatcatacgaaactcctattctactttctgcatgtatatttccaatttctgctgtgcaatctatacattgcaattatatatgacatttgtcgtaaaatcaaggaaatgcaacctatttattgcatattccggaggaagccatggaacaaaaattaaagcaggatttaaggatagggccaaacatccgaaaataccgcctgcagtcacaccttacccaggagcaggtcactgcaaagatgcagctgatggggctcaatatttcacgcagcatatattcccagatagaaggcggcacttacaatattcgaatctccgagctggttgccatgagagaaatctttaacattaactatgaatcattttttgagggcatcacactgaatcccaaggatatacaataaccggaatgacatgaacaggccgcctgtcaaacgacagacggcctgttccaaacacaaaggataaaggtatttacccgcaatgggtacgaattatttaccgtagtatgcttttaaatacatttctttaatctcgctcataagcggatatcttgggttagcgccggtacactggtcatcaaatgcctgctcaaccatgtcgtccagcctgtctaagaagtctttctcatcaattccgtaatccttgatgcaggacttaatgccaacagtcctcttaagctcctcaatcttgacaatcagcttctggactgcctcagcatcatcctttgcctggattccgcagaaccttgcgcactctgcatacctttcctgggtatgaggatactgatactgtgagaatgtgcccatcttgcgcggattctcagccgcattaaaatcaactaccagggaaatcagcagtgcatttgcaacaccgtgtggcaggtgatggaatgcgcccagcttatgggccatggaatggcatacgcccaggaatgcattggcaaatgccataccggccatacaggaagcgtccgccatcttctgacgggcctcaacatttgcaggctcattgtaagcggttgggaggtaatcaaatacattcttcatggccttcagtgcaaggccgtctgtatagtcggtagccatgacggatgcatatgcctccagtgcatgggtcagtacgtcaacgccggatgcgctggtcaggcctcttggctggctcatcatgttgtctgtatcaacgattgccatgttcggcagcagtgcgtaatctgccagaggatacttgatgcctgtctcctggtccgtgataaccgcgaacggggtaacctcggaacctgtaccggaagaagtgggaacagcgatgaaatatgctttctcacccatcttcgggaaggtgtatacacgttttctgatatcaatgaagcgcatggccatatccatgaaatccacttccggatgctcatacagcacccacataatcttgcctgcgtccatagcggagccgccgcccatggccaggattacatccggctcaaattccctcataagcttggcgcctgcctgtgcattggccagtgtggggtcaggctgtacatcggagaatacggtatatgtgatgcccatctcgttgagacggtctgtgatgacatgggtgtatccgttcttatacaggaaggagtctgttacgatgaacgccctcttcttacctaaaacgtccttcagctcttttaatgctacaggcagacagcccttcttaaagtaaaccttctcaggtgcacggaaccacagcatgttctctctcctttcagcaacggtcttgatattcagtaagtgcttgaccccaacgttctcagatacggagttgccgccccaggaaccgcagcccagtgttaaggacggagctaacttgaagttgtacaggtcaccaatgccgccgtgggaagaaggagtattgattacaatacggcaggttttcatcctcgctgcatgctttaaaatcttctcttcttcatttacattcacatacagggatgaggtgtggccgtagccgccgtctgccaccagacgctctgccttgtccagggcctcgtcaaatgtcttggccttatacatagccagtacaggagacagtttctcatgtgcgaactcttcgctgatgtcaacagactcaacctcgccaatcagaatcttggtatcctctggaacctcaacgcctgccagcttggcaatggttgctgccttctgtcccacaatcttggcattcagggcgccgtttacgataatggtcttgcggaccttatcaatttcgcccggctttaagaaatagcagcctctgtattcaaattcttttctgacgtcgttgtagatggattccagaaccgttacggactgctcggaagcacaaatcataccgttgtcaaatgtcttggaatgaatgatggagttaactgccatcttaatatctgccgtgtcgtcgatgataaccggtgtattgccggcgccaacgcccagtgcaggctttcctgaagaataagcagccttaaccatgccggggccgcctgttgcaagaatcaggtcggcatccctcattacctcgttggtcagttccagtgaaggaacatcaatccatccaatgataccttccggtgcgccggccttaacagctgcatccagaaccaccttggctgccgcaatggtgcagttcttggcacgcggatgtggggaaatgatgattgcgttgcgtgtctttaaggcaatcagtgtcttgaagatagctgtggaagtaggattggtggtaggaataacagctgcaatcaggccgattggctcggcaatctttttaatgccgtattccttatcttcctcaattacaccaactgtcttggtgtctttgtatgcgttgtagatatactctgctgcgtagttgttcttgataaccttatcctcaaccacgcccatgccggtctcttcaactgccatctttgcaagtggaagacgcattttgtcagccgcgcttgctgctgcaaagaagattttgtctacctgctcctgtgtaaaggtagaaaaagctttctgcgcttcgcgcattgcattcatttttgcattcagtccgtctacgctgtcaatgatttccggaacaacctgctcgattttctttgccatttccttatcctccattttccttgtgtttgtttcagtacatttaggctgtacctgcctgtcaagtcattttaaattgctgcttaatttgtattgataattaattaacaatctcactgtttgcattatataccttcgttaaaaaaatgtcaatatataaatgaaagattttataatttttttaggaggaaaaaaaacagctatcctctgttggctgtagaggatagctgcaactaaaaacataaaacctatagataactttttaacaattccaccttatccagccgctcccagggcaggtccaaatcattgcggccaaagtgaccataagcagctgtctgcttataaatcggacggcgcaaatccagcatccttatgattccggccggacgcaggtcaaagttggaacggatgatgtccaccagcttctcattgctcaatttaccggttccgtaggtatccaccatgatggaggtaggatgggccaccccgatggcataggacagctggatttcgcacttatcagccaggccggccgccacgatgtttttggcaacatagcgggctgcatatgcagcagagcggtccaccttggtgcagtcctttccggagaatgcgccgccgccgtgacgcgcataaccgccgtaggtgtcaacgatgattttacggccggtcagcccgctgtccccctggggtccgccgataacaaagcgtcccgtaggattgataaagaactttgtgttctcgtctatcatattctggggaagcacctggtcaaagatgtactttttcacgtccgcatgaatctgttcctgggtcacgctctcatcatgctgtgtggataataccacggcatccagacggaccggcttgtcgttctcatcatactccaccgttacctggctcttgccgtccggacggagatacttaagcgtgccgttcttgcggacatccgtaaggcgctttgccagcttgtgggccagggaaataggatacggcatgaattcctctgtctcattggtggcaaaaccaaacatcatgccctggtctcctgctccgatggcgtccagctcctggtcggacatcttgttttcctttgcctccagcgccctattcactcccattgcaatgtcctgggactgctcgtcaatggccgtaatgacaccgcatgtatcacagtcaaaaccatatttggcacggtcatatccaatctcacgcacggtctcgcgcaccagcttctgaatatccacataggcgttggtggttatctctcccatgacaagaaccagtcctgtggtggtagctgtctcgcatgccacacggctcattgggtcctgctccatcaatgcgtccagaatcgcatcggatatggcatcgcacattttatccggatgcccttctgttacggattcagatgtaaaaagtcttctctccatttttaatctctccttcttgttcagataaatgattaacagcagctgtaacatcaaccatttacaaaaaacaaagtccgcagcaattgcggacttgaaaatatctataaatcttcaaatcctcttattgctcgaccaagcatgctttatcctaccagcatactcctcgctcaggctggcaccttccggccctttcgcatatcatgccgatatactcaaccggggttgccgtgacttcacaggtcctttgtacctccatcactctgaataagggatatttacgaactctttaattgtaaaatgtgttaccttccatatcttatagcaattatatatatatgtcaatactaaaatttatcattgcccgttctgccattgccttcccatcctgattttaccttatggaaatcctcccctggccggccgggttcccatactcagatgtcacaaaacctcccatccgccttatataggaagataagatatccacatccaccatgacctcatcccggattacattacatccccggaacatggtcatgccgtcaccgccctgtttcagcatatagttatgggacgccacggtatatgtaccggccaaatcaatgggctctccccccaccttgatgtccgttaccctgtaagcgcctgacacaccggtaaaattccccttgtcgtctgtccggacacctgatttaacagatgcgtcaatggtgtaggtcagaccggacacctgaaggaaaccgccgctctcttccggataattcctggacgccatttccagtgcatccttaatctgctgtcccgttgcctcgatgacgcatcccatatttccataagggaacacggccagggtgtcgttataggtaatgttacccggtttaataatgctccggattcctcctccgttgctgagtccgatatcagcccccagctccgcacggtaggcatccgctgtcaaatcccccagattggtttctgcatttctgatcctgcgctgccctgtggcagggtcattgaccgtcagctcgtaagatgtggtgcccagaacagtctttaatgtctcattgtattggttctcaatggaccggatgaaccggatggttccataatccgcagcctttccgtcctcattgataacgctctggccgggaatcacaagcttaagtcccacagggattacgtcagcatcctttatcttatccaggttgctgttataaatgtcaatccagcggctgtagcttcccagctccctttttgcaatcctgctcagggaatcatggtcctttaccgtatattcactggccaggtccgcggcaggcaccttggataccagctcagtccggatggaaccgtcggcagatatggtcagctttccaatatgattcagcttggttcctgtctgggtcaggaccacattctgtccattcttattctttatgttctcagacggtacagtctcatgggaatggccgtcaatacatgcgtcaattcccgttgtattggcaatcacactgacggatgaccacttccgggtaataccgttttccccgagatggcctgccagaaccacataatcagctccggctgccctggctgcatccgcactggcctgtacctgactgtacagcctctgtccgctctcatcctcgcaaaaggaatacagataatttccctggctgtcctggaaatatgcaggcgtggattttgtaaagctttccggcgtggttactcccacaaatgccacctgggtatccccgtatacaaacatcttgtatggagcaaacacaggcgctcctgtggcggtatttaaaaaattgcaggaataatacccgcagtttaatttaccggccagctccaggaacctggacattccataatcaaactcatgattgcccggaaccgcaaaatcatatcccacgtagttcataatatcaatcagataaccgccgtctgaaagcgtgccaatgggcgcaccctgaatggcatccccggtatcaaccagggtcacataaggggtctgctgctgcatctgcttcttgtacagcgccagaccggcatagcctatgttgtcatccaccccgcagtggacatcattggtatacagcaccacaatatccctgtccgctgccagggctgtcattggactgcctgtcagaggcaggcccgtcacggctgctgcggccaggacaattgcaagaaacaaaccctgcagccatttatagctcctgtacttcatgattctcctccttttcccctactccgtcaaaccttacacaacgtatatcatacagccatcatatcacatttccagtaaaaaaccataaaaaaacagcaggcacgccgcattcgtctcctgctgtttcctttcctctgatttaccggactctcatcccctggccatttccagtatcttccgtacatcccggtgtgtcagcggttccagtcccccgattgtctggtttccattcctgaaatttatatggtccagcatgtcttccatatcgcagtccccaattccggcctctttgaggctgacaggcatcctcatggaccggaagaatgcctcggtggcctctatccccttatatgcagcttcctccgggccgtactccctggagattccaaacacctcatacccgtatctggcaaaccggtccacatggtttttatacacatacttcatccatgaccccatgattacgcttaaggtaactccatggggtgtatcgtacagagcgctcagctcatttcctatctcatgagtggcccagtcctgtatccggccgattccaaccgtatcattgtgggcaatggttcctatccacatgacctccgccctgtaccggtagctgtccggttccttcatcagggcaggtcctgcctctgccagcgtcttaagaattccctccgccatacggtcaatcaccccgatttcattgtccggagtaaaataccgttcacacacatgggaaaacatatccgtaacagaacaggccgtaacaaacggcggcaggctggttgtcagcagaggattcataaaggccatcacaggccgcagggcctgggagctggtcagcagcttttgccctgttcccgtattgttaatcacacacacatcccctgactcgctgcccgtggcagggcatgtaagcacgactcccactggcagggacctggccacgcgtattcctttggagaagaaatcccatacgtcaccttcgtactgcgaccctgccccgatggccttggatgaatcaatgacgcttccccctccgatggccaggataaactggattccttcctgcctgaccagacggattccctggtaaaccaggtccagacggggatttggtttgacgccggagagttcccatacctggatgccgcatcgctccatatcctccttaatatccttcaaaagacctgtatcatacagatacggtccaccgtcatggtgaatcagcagacgttttatccccaattgcttcagtttatccccagccctgcggtgtgcttcccgcccaaatataaattccgtattcacacaaaaatcaaaatcccttatcatattcccactgcactccctttctcccttttcctttcatacagcacctgtcccagaatctccctgagcttccatcccgtatccgctgtccagtccggatgttccgccagaagcgcctttgtatttccatccccgtataaaacagcaatcacaggcagaccgcagcttctggcagccgttatatcggtccaggtatcaccgacacagaccggatgccgggatgcaaacattccccccatgagatacctgtacacagacgccttattatcagctcccggtattgaatccagggaataggaaaccggaatcagctgttcccatccctttaccttaagaaggcgccttaatgcctcccggggctttgaagtgaccacggtccatggtatgccatgcatttccaggtcatggaatatttcctccagccccggatacagccttgtcttttcaaagggattcatggtcctgtaatggattctgacagcgctgcagaatgcttccagtttttctattccgggatagggccttacatgccttagcagctcctcttccgggagagccacatgggacgtatccttcataaaatcccggtccataatgccccccactatttccgaggcatattccaccgacgcccacacatcctctatggtatctgctatgacaccgtcaaaatcaaaaatcacactgtccgctctctttgttctcatctaaatttctcctttgcggcaaaacaccatttgctccaaagcgtgccggccactaccagtaatgcgccaataatgacagggagcgtaatgctgagtcccagcatccaggccgttatgaccgtggatatgatgggaaggaaattggaagccagcacgaccaccagcatatttcctttttttatggaaatggtccacagcacattggcaatacaggacaccgcaatggcctggtacagcatttcccataccagcctgggcgtaaaattccttggctcaggaaggaatacggaaataccgcccagtatcagggcagacataatcatgtatattcccacgccgtccaccggcttttgtcccaggtatttctttgtgagattggtgtaaaaggcccatgacagggacacaatgaaccccatcagatatgccatccagtttccgctgagaatatcccgtaaaaatgcctggggattgtgaatgcttccgcccattttggctatgatgataccgcacaggctgaccgctacgctggctgtcagccatgggctggcttttttattcagtatgggaatggtgagaaccagggtgaacagaggccataagaaccgaatcagcaccatggtcatgatttctgcctccgtatgaaccatctccatggagatataggaggcagctgtgtagataacaaataaacttccgcagataatccagtatttaggaggcgctcccttatactgcgcggttcctccgttggcgaggagctgctgggcgaccaccacagctcctccgattaaattaaccactgccgctgccgtataaggaccaaggccggaactcagattttttgtaaatgcagcgctggttccccatataatgatggttataatcccaagcagtgtatatttattagacttcatctgaacacctcattatccttttcgcaatatttttatgtgcttattacggataacaggccagtgtcctgttcagaagttctgtaaatccctgaaaatccaatgtaagaccagcctctgcattgggctgttcccccctgaagtccatggtgggttccctgtgcaggtcaatctcaggctccggtccccgcagatgccggtaatcgcaaaccgtcattccccttgtgaattccccctttaactccactgttatatgcatgggggcaccttttataagggtatcatcaatcagccacgccaccgcgcatgcatcatggatattggctccggccaggctggcattcttctcagttgcgtccataaagtactctaccagctgtgctgcaaacacagcgcttcttgttcctatccggtaaaattcatccacatgcttctgtaccaggaaacactggcgtgtcaggttgacaccgcacatctttacgtgcattcccgaattaaacaccctgtacgctgcctccgggtccacgaatatattaaactcagctgccggcgtccagttgccgtatgtgacggaaccgcccatgatgcttaattcacggacacgctccacaattccgggctcccggttgatggctgccgctatattggtgaggggaccggtggcaatcagggttacatcgtctgtattcatgattgtctcaatcataaaatcaactccgtgtttatcctgggccttaacagacggctcaggaagcaccggaccatccattcccgtaggtccgtgaaactggggcgctgtcaccaaaggcgctaccagaggacaggaatggcccggatataccttgatatcctcccgtccaataacctccagtaccttcagcgcattttttgtgacattctccaggctgcagtttccgcctatggtggtgattcccagcaggtccagatgggccgccgccagcatgatggcaaaggcatcatcatgaccagggtcacaatccagtattacttttctcttatcgctcatattacctccatccaaagccgccttaacctctctgtggttttggccgcttttcagctatgaataattccacatcttccctgcagggacaggacctggcgccctttcgctccacggtataaccggacacagcatttccgtattccagacactgtcccaggctgccgcctgccagcctttttgctatgaatcctgcattatacacatcccctgcccctacggtatcctctacctctacatgaaaggccgggcacccggtctctccttccgtggaaaaagctttgcttccattttctcccatacgcgcaatcatgacatgccctacggataccaggccccgcacgctgtcctcccagtcatccctgggattcaaataatagaattcctcttcccctgagcccaggacatagcttgaatacttcataatttccatcacagcatcccggtaggacctgtccagtttaccgtcgtccactctcaggttcaggtcaaaggaggtgggtatccccctctcgtacgcggcccggaacatctgtatgatggaatgtctggcggacgtgtcatccacaattgccatgccggacgagtgaagccatctggtatcggaaagccagccgtcacccatgcgcctaaggtcgatttccttaaacgcctggtctgtgcgcggccatccccacagataccgctccccatactcgtctatgaaggcaaacacacacacggtattcctgtccgggtcttccatcatatacgtggtatccacgccttccctttcaaaatccctgcgtatatacgcgccgtactggtcacatccaatggtgcctgcaaatcctgtctcgacccccaaccggcttaaggccaccgccgtgttggcacaggttccccctcctgccatgcagggagaggggtattccaccagggttctccgttcattgagaaacctggggaagggcacaatcaaatccacattggcatcgcctgccaccaggactttaggcactaagggacgcctcaatgaaggcctttaccttttccgggtctttgcaggattttccttcctccacatggtcgaagttggtgaggctgaaggaatccaccccgtaaggccgcgtctccgcaatggcctttgccacattggaagcgtccagtccccccgctataatgcagggaacggatgtgctctcaatgatagccctgtctatgcttctgtcgtgggtcagccctgtggcgcctatgtcattggctgtatctgcctttgtgtcgatgaggaagaaatcggaaacagcctcatattgctttacatattccaacgccttctgctcctctaagggcacattctggagcaccgggattgcctgcatgattttaaggccgggaaaccggtttttcagctcccgtacctgttccgggctgattccctctatatttccggaaagatgaagcacatccggcaggacctcctttaaattctccgtaatctcctcaatgtcctcagcaatggtcaaacctatcttaacagcctcaggctgcactccctcaaaaatttcctttgccctctcaagggtcagctgtccgggggttctcttgattttaccgtaggaaaccccaatatggtgggcccccatctcaatcaccattctcgcatcttccacggtacgtatgccgtaaatctgaatcttaacgtctgccatattattttctccttctcccaatcattctgctgcctgcgggaatgcaatgcttatatcccgtccccggctccctttatggatgcttcaaggcatttcataaatgcatccaccttaaacacagtttccttaagccctgcaccctgggcaaccctggtgatgggcggcggggatacaaagctctgttttaaaagctctgtcctggcaaatacctctgcagcaggaccgtcaaccagcacctttcctttgcacatgaccaccacccgttcaaaattttccaccacgaatttcatgtcatgggaaattgtgatgcagagttttcctctttcctttaaggctgtaacgatgtccttcagccgcttgtttccgtccacatcctggccgcaggtgggctcgtcaaataccagggcctgcgggtccatcatgatgatggaagccactgtacagaatttcttttccgtagcagtcaggtcaaagggatgctcctccagcttatcctccagaccgcacagcctggctgtccaatccagcagctcctttatcctgtcctcgtccatcccaatctgtctggggccaaattcaagctctttcctgacactgtccaaaaacagctggtcgtccgggttctggaacacatatcccactgttttggaccattgggccgttgacctgctgttgatatcctctccattgaccagcacctggccggatgtgggccggagaattccgttaaaatgcttcaccagcgtggtttttccggctccgttctgtccaatgatggccacgggctcatttccctctatcaccaggtcgattccctttaaggcttcatccccagttggatagacgtgcttcattccttttaattccagcctcatcctgccatcacctccttaaccagctgaatggtatcttcctcaataacctttaccggtccattgtacaatcccctgtccttaagggcctgtgagacagccacataatcaggcgctccaatgtggtgggacatgatatccggatttccaaatatagcctccggcgtatccagggcaatctgctctccctggtccagcaccagaatccggtccgcgcatctggccacccgttccatatcatggtctaccataataacggttacgccgtttttattcagttcctttacaatatcaaatatctcttcacttcccagggggtctaactgggtggtgcactcgtctaacaccagaatgctgggttccataataaaggtggaaccaaaggcaactctctgtacctggccgccggaaagctccagcggatttttgtgtatgatatggtcaatccgcatgagcttggccacatactccaccttctttaacatatcctcccttggtatccccttattgcccagcccgtaggccagttcctctgccacgcttccggccgtgtaggaaagctggttaaaaggattctggaacaccaacccgattttggacgacagctctgcaatggaactttcctgtgtatccactccgtccacaaaaatctgccctttcagcttacctgtaaaatagtagggaatcaggcccaccagtgcattgcacagggtggacttgcctgagccgttctgcccgataatgcacaggaactcccctttttttacctgaaaattaagcccgttcagcactcttcttttggcgtccctgtatttaaacttcaggtcttttacttccaatactgcttgttccatagtgtcctcctaatacataccttaaataacatgaagcctcatgagaatgctggctgccagaaccgccataaaaaagagaatcagacaggtcttgcatatccggtccgagagggaagtggtcacctccacataggtggtgggcttcaccccttttatgccgaatcccctggtttccagggtcatgcctctttcctgggcatctgtaagggaagacataaccaccggtcccagtaaaggtatgtaggccttcagcctggccatcatggtgcctttggtatccacgcccctggcattctgcgcttcctggattacgctcatcctgcgctgcatctgaggaaccacattcaggcttgccagaatcagatatcccaccttaggattcatgcctgatgcagtgagggcagccaccagcttacccgtgtatgtggtggtggacatcagataaaaacttcccaggaatgtaaggagcgtacccacgattttaagggcatacagggttccctccagtcccagctttgcaaatcccaaatcagcgataatggtcacgtttttcggactgtacaggccctgtataaacatcagcatcacaaaaatagggacaaaaaacataaagataaatttagagaatttctttaacagccctgccagggcggccacaacaaacagaccggccacaattatatatcccaatatgaatcccggataaataagggcgcttaatcccaggcagaatatcgcatatatctttaccattgggttcatcctgtcaatgggcgaatccattggtatgtaattagatgtctttgccatcttttttcaacccccataagagtattttcagaatcataccttcctgccgctgtccggattaatcctcatcgtcatcatcatcgtccgctgcatccactgcatactggcttaagaacctcttgggaatcctctttaacaatatgtaggcaatggcaaacgcaatggcgcggtccgccaggttctcaaccatggatgaggcaaacacggatttaacaatatcctttgtagcggcaatcaggccggctgtcagtacggaggttcctgttgctcccgttgccccgccgaatacaaagatggttatgcaggaagaaatcacaacagatgaaaaggtaacaaccagccatgtgacaaccacgccccaggtcttcttaaacatgccgcccttaatcatataaccggtaatcagaccggccgcaatgcttacaagtgagtatggcacatagattggattggacaccagggccaggaagatattggtgaggaatccgaccagggcagctacccagggacctgccagggcagcagacagaatggtgcctatcatatccaggaacaggggaagcttcagcgtggaagcaagcgttcctccaatcaggttgattcccaccgcaatcggtatgagaaccagggacttggttgagaactgcgccttcaaaccttgtacaaatgtcagtttctgtttcttgttgttcatgttacaccctcctaaaatagtatgattttcatgcagtacatcctgtatgccacgaccccttttgccttaaaaaacatatcttgtaacatataagatgtaatacaagttgattatataaaaaatacattggaaataattttcctaatgcattttttatgttccatataccctgtcaggcttcgtcatgtaccatgttctccctgacctccagctcaatctggtcaaagagttcattgttcagtttttttaatttggggacatcccctgttttgatatattccagcatctttgaatggaaatcaatgccctcttctgctccccgttccgtcaccgcttccttcatggctgcgctgagtatatcgtaaatcagattgctgatttttatgatgaagggattgcctgtcatctcatacagcttcatatggaattccaaatcatatttggtatactttttaagattggtcctgtagtactgtttcatcttatccagtgtcctggataagaagacaatatcccgctccgtggtattcctggtatacaggtcaatgattcccacttccagaattcttctgtattccaccacaaacagtatatcccccggggtcatgagaagcatgggcgtcagggacttcagataattattggtggtaaactccttgacaaatgtcccttttcccctgtatgtctccaccaaatccatggcagctaacttctgtatagcttcccgcacagatatacggctgacgcccataatgctagtcagctcattctctgaaggtatcttctctcccggtttccatttgcctgtggtaatctgtgaaagaagctggtcaaaaacctgttcccttatatcctttttatccaatgcatgcaaatcaaattctgcactcatatcatcatccattctccgggccttctgcatgtcaggccgtttatttttcctatctctgataacttgtattataacttacaagtacttttctgtcaaatacttcttataattacaggtatttttctcatatttaatacatttttacttgggtttttcttccgcggacgcacttttattgtgtatattgcactaatacaatccgatttccggatttcagcgcgtctttatgactctcccgacagctccccttcattggcctcttccctgcatatctcctgcccgggctggtaatccgtcacagccagctccatcacggcctgggggtaattcacggacatcctgacaaaccttcccttttccctggcagcctcagacgcaattcctgcaatctgctccagcacgtccctggtcagatacccgccccgccaatggaatacataatagggctgtttcttcctcagcactgtcttaaaacgcccggccacatcctccagcctggtcagggacagccggttctccctgtaataaaacctgcctccgtccgtacattcaggcactttatacaccaaaggctggtggtccctgaatatcatcttgtcatccaggttaaaataatcaaaccgcttctgtccataccgtcccagggaattgtcaaaggtggcatccaggtggtaccatgtgttttttagctttaccagattccaagcatggcggtatttaattcccctgtcaggggctgattcgcttatggctatgatgcattccagtcccagcctgccgcacagtattttcacggtcttggcaatgccttcacagaccccgattccctgctggagagggcctatgatttcatgggaatactgctttttcagcttgtcataggtaacattggagcagataaagtcatgtacatacttctccttatcctccggcgtcatagcctctgcctgacgcaccaggcggctgattctggactccagagctgtccgcatttcctttatcttctttttctcaaacatatattccggtatcatctgtacatactctgaattctgggcaaaccggtaatgaaagccctccacaaaaaatatagacggatggtccaggcgcagcctgaagaaaatatccgacagctcctttccatccaggcgcaggaccggaaattccggcgataaggcctcaaatccgtccagcatggccctgtaggcattctgctgcgctttactcatctgctggtaataaaattcctgtttcatattcgttccacatatccttcttatgtctgtttgtccgggttctgttctgcctctgaaagaaaaggcaggaaccatgcaccttccggtacaccctcctgccttgtattctctcctgttatcaaccaaccctcagtttaaacttctgtacttcccggtcagaatctactttttcaatcatggctcccagtccctggagcttttcttcaaaacactcatatccgcgctggatatatccgatttcatccaccaccgtatagccgtcagccgccagtcctgcaatcacaagggctgctcccgccctcaaatccggtgcattgacctgggctcctgtcaggcgtttcacgccgtctatgacagccacattgccctctacctttatattgctgcccatgcgggccagctcgtccacatatttgaacctgttctcaaaaatactctccgttaccatgctggttccattggccaggaccagggcaaccgacatctgaggctgcatgtccgtaggaaagccgggataaggaagggtcttaatatccgtatgtctctgggaaggttttcccaccacccggaccgcatcgtcaaattcaataacctcacagccaatctccgtcagtttggcggaaatggcttccagatgtttgggaatcacgtttttaatcatgatatcgcctctggtagctgcagcagcgcacataaacgtacctgcctcaatctggtccggaataatggaatactccgtgccatggagccggttcacgcccctgatacggatggtatccgtacccgcgcccttaatattggcgcccatactgttcaggaagttggcaacgtcaactatgtggggttcctttgcagcgttctccaaaatagtctggccctctgccagggccgcagccatcatgatattgatggtggctcccacagaaaccacatccagataaatatggcttgccaccaggtcgatggcatgggctataacagccccgcgctcaatggtaacctcggctcccagagccctgaatcccttgatatgctggtcaatgggcctgctgccgatattgcatcctcccggaagaggaacctgggcgctcttatacttgcccaaaagagctcctatgaaatagtaagaagcacgtatccttctgatatactcatcatcaacagatacctcgcttatattgcttccatttatctttacagtgtgtcggtcaatcctgtcaacccttgcaccaatttcctgaattgcctctaacagtacattgatatcccttacatccggcagattatcaatcaccacatcctcgtctgtcatgatagaagcagccagtattcccagtgcggcattcttggctccgcttatggtcacatctcccaccagtggattcccgcctttgataatatattgttccattccacacctctgatttttatttaaacaaaccctatatataaggaaaatactcctaaagaaatctttaaacatttgttcataatttatttacatcttcttagattataccataagaatcagatttgtaaagtaaaacgaaaatgcacaccctaaagtacactgtctactccactgccagagcgcacaggaaatcattctgcaggttcttaaaatactctgtggcatcattgagccccatcttttgtgtctcctgggtctgagggtcatagagtgtcacattatactggtcatagccggataaaagcacatactgtcctgattccacataagctatcacagggatacccttgtcaatatagtacagaatctggttcaggctgcatcctcctgcatcgattagtataagtccgtcctcatagacacggctgccgtcaaatgcgtccagatactttgtaaccttccttgcctcatccaccggagcttttatattgcgtatgggctgcctgttgattctgtcccacacaatatgctggctgctgtccgtcacatagcccatctgtccataggccatctccactgcctggctgaaggttctggatgagccaatgtaatgcccgcctccatatgccctgaataccatgccgttctcagatgacggggatgccgcctttcctgtatccagaacgcttgtatattcataggaaaatgccttgggcgcagatgtacggaccttatctccgttaatttccgaatctgactggacaaaataaacctttcccttatcctgggaggcaaaccagccgattccctctaaggggtccttctcaactctctggttacacacaatggtatcctcattctgatacagatactggttctctcccaacggcaccagacgcttcagatgaattcttccgtcctgggccactacatccgttatataaatgccgtccttcctgtattcgctctccacctgcatctgtgtatccacaatgtacattgcatacataggcatacccttcaggcggccgttgacaatccacttatccttggagttgctcagtccgtaaatcaaatcatttccaacaaaccccagtaccctgacataatcatttacctctcccacgatttcctgtttctgggaagtattgaaatccataacatggaccttctgggactcatacaggttctggccttcctgccatgcaaaccggctggcgtccccgctgacagcatagcttccctccgtcagcccctgggccaccacaagggattcattgctcttaaggtcaataccgaatacagtgccctgaagcataatgtacatcatatcattttcactgagataggacaatttgtccacatctgctttcaccatctcataggattcggatgcaggcaggaaaaacttctcctgaaccgtatcctgctccttatcatagcggtaaaatacaacacccatccggccctcatatttgcccctgttcatatatccatacaccaggaaatccatggaaccatcgtcctgcacggacaatatctttatatcatgtctgtcgtaaccgcttcttaccctgtcgtctgaattgcttctgaaggagaatacgcatacggcctgtttatcatcataatcataacaccacaggtcaccgcctgttttaaacgccacataattggactttggactcttcatggtccttaccttgtggtcattggtgattccaagaagaatctttttgcctgaaaaagaccggggtcctccgtcaaactcttcattggcatttcgctcatagttcatgaggtaaattctctgttcattccacttcatggtgaaattgtcctctgcattcaccagggaacgtgttccgtcctcctcattaatggcaacctggtaccgaatctggatttgtcccatgatgccgtcaaactcctggagagttaccaggggctcacccaccatctccacatccaggccatcccatgtcagatgactgaagctggccctgatggtaacatggcccagggagctgttatcctctgtatcattggtttccagatagaataccaggtcccttgcctgattgtaatccaggctttttctggtaaactcctcagccagccggaccatatctgatgcataggtgttatccggccacatgattcttgtgtaataatgtatctccttttcccctgtggttactgtaattgacagaagatatgtttcattcctggccagcaggttttgaatcggcagcactgcgctgacacttccgtctccgctgtcccactcttccaccacagtccgctccaccagcctgtccagagtaagattcctcacctcgtagctgatgcctgtaatggtgcttccatactcctgtatccggatatgaagcccacggtcttcaggcagcacagagatactttccctggctgcctgattccccatctcctgcatgtatccatgcaggcaattgatttcctgactgcccagttgagtataaaccactggcagcgacggttcttccatggatgtatatacggctgattctttttccattgtgtttctggcactgatgaaatacacaaccaatgcccctatgaatatcaggaacaaaatccctgctttttgcaatattttcttcatatgtgattttatcctttaaactggttgctctgtatcatatctattttatataatatccagtaaaactacaacttaatcttttcggaattttattaataatatatttgtcatatccttactgctcctataaggcgcacatgcctctggcgcatctcctgtggaacatttcgttgagcagaagcaccttaatcatgtctcttaaccaggatggtttgtttccgtgattgggaggcggaggaaccggcctgggaggtctgggcggcctgggcatgggcctcggaggaggtgtaggcctgggcggctgcggcggcgtgggcctgggcggctgcggcggcctcggtggctgtggcggtctcggcggcggcgtgggcctcggtggctgcggccttggtggtggtggcgtgggcctcggtggctgcggcggcctcaccggaccaggtcccatgggtggtctgccttgaccaggtcccataggcggtctttccgggccagggcccataggcggtctttccgggccaggtcccataggcggtctttccgggccaggtcccataggcggtctttccgggccaggtcccataggtggtctgctctggccgggtcccataggtggtctgctctggccggggcccataggcggtctttccgggccaggtcccataggcggtctttccgggccggggcccataggcggtctgctctggccaggtcccataggcggtctttccgggccagggcccataggcggtctttccgggccaggtcccataggtggtctgctctggccggggcccataggcggtctttccgggccggggcccataggtggtctgcccggaccaggtcccatgggtggtcttccttggccggagcccataggcggtctttccgggccggggcccatagactgtctttccgggccggggcccatagactgtctgcctgatttatttcccatgggcagcctgcctgaaccctgccccatattaggtcgtccacccattctttcatttcccggaaaaccaggttccatagctcttatttcctgagtctccattatgattccggatggatttaccactgattccctgtatccctggaaatcatattgggtattggaaatggcctgctcttcctgtaattcctcagtgatttctacgtcctcattctcaccaatgtcttccgcctcacttatgtcatctgccggaacattcactaattcctgttcctgctctacttccaactcattatcctctgtaaacaaatcctcatccagccggctcatatcttttttgagttctgccatttccatgacggctttgtcattctctgatatgttccacatgcttttgactttttccgcaccttcagatgcaatcacagtatcacagattgtattgcaaatccggttaatcatcatatggtcaggatactcatcatacatagggctgtttttataatccaatctgtcgcaagcttctgccacatacccctgcaagattcttattcctgatggatacatacttttcaggtattcaatgtcctgcatctactctcccttttccaattttctcttaccaatatcatatgcaggccaaatccattatgcgccaactttccaaccatttctctaaaaaaataaaagaccggatattttccagtcttttacaattattatgtggttaactttttttaatataaccaagagcctgttccaacgcctcttgttcctcattgcccagaacaatatcggtctgtcccatatccaccactttaatatacagataacaaccttctctgctgtgaacgcagtttaatacaaatccgctgtttgtgtaatccaacatggcaaatgcaaaactgaggttccctcccattcctttaaaggcattatatttgacaagcccatacttttgaaatgaggctctctgattccggtttaatgttcggatggaatccttatttgacctgtcttcggcccttaaatccctgatttcttcaatctggtccagaatgacatcttccagagtctctgcatcttttcctctcataaaatagtcatattggcgatttagccttcttacatttgtcattgttgtaatcgtcaatatcagcagcagaaccactaatatcaataaccctgctatgatatatgcagggtcaaagggaatttgatttaagatgctgttctccatataatatccatctctcctttgtacctagcgaattgattcaatcatttccacaatccgctctaattctgcttcagaataatattcaatttcaatgcgtcctttatttttatccttgttgtggatgctgacctttgtacccatgacgctcttcatacgctcttccaggctctgatatatcaaggctaatgcctcgtccttagatttgtccttcttttcttctcctgtctctgcttcctttgccagccgttttacaagacgctctgtttctctgacgctgagtgattcatccaatatcatctttgcagccttcagctgaagtcctttatcttccaatgacaatagcgctctggcgtgaccgctggaaataagattctgaatcagcatctcctgtatttggccatccagttttaaaagacgcatggaattggtgatggtggctctgtttttcgataccctggccgctatttcctcctgggtcagcttaaattcagatacaagacgctgatatgccaaggcctcctcaataggattcaggtcagctctctgcacattctcaatcagtgctatttccatgctttcctgcttgttgtactcccgcagaacaaccggtatttcctttaatccagctatcttggcagcacgccatctgcgttctccggcaataatttcataaaatgtcccctttttctgaaccaaaaggggctgcaaaataccatatcgtttaatggaatcagccagctctgccagctgttcttcgttaaaatcctttctgggctgttccctattgggttcaatcaaggccattttcaccaataattccccgctgttgccatctcctttatcagtggtagctgcctttgcctttgcaatctcctcttcgctttcctttatgacatcttctccaaagatggctcccaatcctttacccaatccttttttagccattacaactcttctcctctgctcataacttctgccgcaagcattctatagctctcagcccccgttgaccttgaatcgtaaagattaatagacatgccatgactgggtgcctcagccaggcgtacatttcttggtataatggttttatatattgttctgtttaagctgcttttaacactttccactacttccagtgacagatttgtccttgcatcgtacatggtaaataccacgccttctaattccaactccggattcagttttctcttaaccaaatccacagtttttaacacctgattgagtccctccaaagcataatactcacactgtataggaaccagtacggtatctgcggccgtcagtgcatttatagtcagtatatttagagatgggggacaatcaatgatgataaaatcgtatgtatctcgaacttgattcagatagctgctcagaagcttttccttattctcgacttcctgaaattcaatctctgctcctgccagattcatatcggaaggaagcacgtccagatttggctgtatttccttaataatgcattcatccacagatgcctcttcaatcagcatgtcgtaaacagtcctatcaaaatcttcctgttccagtcccagaccactactggcatttccctgggggtcaaaatccaccagcataacatgttgtcctgcttcagccagacaggcagaaagattaatggctgttgtcgttttaccaaccccacccttctgattggctattgttatgattcgtcccatatgtataaattcctttctcgaaaaaaacaaacttttcttcgattacttttacgattataacacaagtcctatgcttttcctacgggaaattaggagaaaaaaagaattttcatgttttatacaaaaaaatgtttcacgtgaaacatttttaatgcagaaaagtggcatcctaatcctaccctgtcttaataataatttaattctctaaccgttgtaatagcccccagcttgtattataatggagaagaatcaaaaaaccggctatataatatgtaatttcaggagactattgaatgaaaaccaggaataaattactgaccttacttatactgtcatccggagctgctgctgctactgctctgattaacaaagctataaaactttcggccacgtcccggaatgtactggaagaaccagaggcactgtgttataaatggcgcttaggaaatatacattatactaaggtaggaactggtaaacctattctgctggtacacgacctggctcctgcctccagcggatatgaatggaagaatctggttggaaaattagcagagacatatacagtatacaccatcgacctccttggttttggccgttcagagaagccgaatctcacctacaccaattatctgtatgtccagcttctctctgattttataaaatcagagattggacacaggacagatatgatagccagtggttcctcaaccgcattaggtgtcatggcctgcagcaatagtcctgagctctttaaccagctattctttataaaccctgagagtcttctctcctgcagtcaggtgcctggaaggaatgcaaaactttataagattatattagatttacccattgttggtaccttaatatataatattgcttgcagtaagcagtttataacaaaagaatttttgacaaattattattataatccctattctgtaaaggcaagaataattgatgcttatcatgagtcggcacatttaggtgaatctcctaaatctgtctatgccagcttaaaatgcaattatgttaaatgtaatatagcgggcgctcttaagaaaattgataacagcatatatttattaggcggaggcgccttagatgatatcagggaatgtatggaggaatataaagaatacaatcctgccattgagtgtgcggttataccaaacacaaaattactgcctcatttggaaaaaccggcagaagtttttgatatgattcaaacttatttatcctaaagcaggaaaatgtttcacgtgaaacatacggttcggattgatatttccggacctttttttactattacatcaatgctggaaaactgattacataacaaaatataccataaaaagaaagggaccttttatatgctacgaattggatgccatttatcctcatcaaagggatatcgggccatggcaagggatgccaaaaaaataaacgcaaatacatttcaatttttcacccgtaatccacggggcggtaatgccaaagcaatagatgagcatgatgtgaaagaatttttggcggaggcccagtcacttgacatcagtccaatattagctcatgctccatacacgttaaacgcctgttctgccgacccaaaattaagagagtttgctaaacgtaccatggcggatgatttagtaagaatggaatatacgcctggtaatatgtataacttccatccgggaagtcacgtaaagcagggaactgatataggcattcattttattgctgaaatgttaaatgaaatacttgccccggaacagaccactactgtcctgcttgaaacaatggcaggaaaaggtagtgaggttggcagtgggtttgatgagttaaggcggatactggatttaattgagttgaatacccatatgggggtctgcctcgatacctgccatatatgggatgggggctatgatatagtcaaccatttagatgatattctgacagagtttgataataaaattggattgaatcgcttaaaagccattcacttaaacgatagccaaaacccattgggcgcacacaaagacagacatgcaaagctaggtgaggggtatattggactggacacttttaaacggattgtcacacatccggagctgaaacatcttcctttttatttggagacacccaatgatttagatggctatgcacatgaaatacaaatgatgcgtgaagtggcagattaatcttaaaattatagcatagtcttttaatctgccattttaaggacctgcattactatctttgtcagataaaatatttctattttatattctttatttatcttgcatatgagtaaaataagaaggtatcactgatattgtaccttcttatttttataactataaaagtgttacatttattatttaattatataattacaatgcttttatctatagttttattatttgctttcgttaaatcatgattaaactcttgtttcattatatatacaaacgcttaataatcttgaattaattcttcatataactttttatattattatatctaaacctatatttatatcttcagcttgtcccattcgttatatatctatatatacatctatctgacatctaattatttcaacctcaactgtcaacagcctatatacatagattgacttatatattaattgatatcctaatttctattttcatttctagttccatttatctctatatatatctatactcctatatacttattttctattcgagcatattaaaatagtttatagctaaaatttgagtttttacctctcatcttatctcacttcttatcttatttcttatctcatttcttatctcagctcttatctcagtacctatctcaattcttatctcaatctttttcagtctatacctaatcttccattacatccttagcttattcatatatttatatattcattgcttctacctgaaaatctccttcctctcaatttatttcttttatttatctctcaattccatctataagtttattccaatacaatccgcaaaaaaaaggaatgtttcacgtgaaacattccctcctacagtaccaatctctctttaacatacattaattaaactctaccccaacggctccttagtcggcatacctgcttttctcggatacttcttagaaatcccctttaccttcttaataaccaccaaagacctggaggcatctgtaccgggcagcataaatttatctacaaattcaagctctccccccaatataccaatagctttacctgcggatttcaattcctcttctatctctccggacttataaggaacaaaaaaaccaccaattttcacaaaaggcatacaatactcagacaaggaagccaaattagcaacagccctggacacgcaccaatcatatatttctctgtgctctgtctgcctcccaatatcctcagctctcccatgaacaaattccacgttccttaagtccagttggttacagacttcctctaaaaatttgaccctcttattcagggaatcaagcaatgtaagctttattcccggaaatgctatcttaagtggtattccgggaaagccagcgcctgtgcccacatctataacagattttccatccagcatacccttatcatagacaggaccatcattgctgttacaatcacttaagacaccgctatctctaccgcaaccaaatgccctgtccatttcccctatcttcagcactctaaacagtgacaagctgtcactaaaatgtttggacaccacatccggttcatctgttatagctgtcagattcatcaccttatttttttccaccagcatttcataataagtaaaaaactgctcgatctgtttctcacttaaccttatgcccaggagtcctgactcccggtccatccgctgtctaaatgtatctgtcatatcggatcctctcactgctttctcgtaaaatgcaccagcaggacagatatgtctgccggtgatacgccggatatacgggacgcctgtccaatggtggccggctgcaccttattcagcttctggacagcctccctgcggagactgttgacttccgaatagtcaaagtcctcaggcagcttcttattctccagctttttaaactgagcaacctgctgcatctggcgctttatatacccctcatatttaatctcaatattaacctgttccctcacatcatcaggaagcagcggtctgtctttatccagttccgccagtttatcgtaatccaattccggtctcttcaccaactctgccagcgtaattccggatttcaataacgtgcttccatacttttccaaatacgcctgaacctggtcatttacacctatcacagtcttttccagccgttttatctctgactgtatatcatccatcttctttaaaagatgttcatactcctcatggcttaccagaccaatgtcatagcctatttttctgagcctgatatccgcattatcctggcgcagcaaaagtctgtattctgccctggaagtcatcattcggtagggttcgtgattctcctttgtaaccaggtcatcaataagaacgcctatatatgcctgtgaccggtccagtacaacggcttcacgcccctgtatcttcctcaccgcattcacgccggccatgaatccctggacagcagcctcctcataccctgagctgccattaaactgtccgcctgcaaacaaaccggaaatcttcttaaactccagggtcggcttaagctgcagggcgttgatgcagtcatattcaatggcataggcattccgcactatctttactttttcaaggccgggaactgtacggtacattgcatactgtacatcctcaggcagagaactgctcatacctcccagatacatctcattggtataaagtccctccggctccacaaaaacctgatgtcggttcttatccggaaatttaaccaccttatcctcaatagaaggacaataccttggcccggttccttcgatagcacctgagaacagaggcgaacggtccagattttccctgataatacggtgtgtgtcatcattggtataggtcagccagcaggaaacctgctccttctgtatatcatccggattcgttgaaaaggaaaatggcaccaccctggaatctcccagctgctcttccatcctggaaaaatcaatactcttcttatccactctggccggggtccctgtcttaaaccggaacatctcaatcccgtttgccttcagggattccgtgagatgattagctgcctgaaggccgttaggccctgtaggattgctcacatccccataaatacacctggctttcagatatgttcctgtacacagtattacagccttggcatgatacacagcgccagaaaacgtttttacaccgctgactgccccttgctccaccatgatttcggacacttccgcctgacgtatggtaagatggtctgtattttccagggtctttctcatatgcctgctgtaatcctgcttatcagcctgggcgcgcagggaatggacagccggtcccttggattcattgagcattttggactgtatgaaggtcctgtcaatgttctttcccatctctccccccaatgcatccagctccctgaccagatggcccttggagcttccgcctatgttgggattacagggcatcagcgctatgctgtccacgctgaccgtaaacataatggtttccatgcccagtctggcactggccagagctgcctcgcatcctgcatggcccgcgcccacaatcaccacatcgtatgtttcttctaaataaggcatcattccacgttcctcttccatatccatgagtcaaatttaattggtaacaaatttcagtccctgacacaagctcccctatttacccatacagaattttgcaaatatctcatttacaacatcatcgtccactgcctccccgataatgaatcccagctgttcataggcattcatcaggtcaatggaataaaaatcctccggcatgttgtcctcaacgcttccctttaccatgttaaggctctcaaggcactgctccaaagcctccttgtggcgcgcattggtaatataaacctggtcattgaaagacagctcaccgtgataaaacagcttcttgatttcctgctccagaagttcgataccctgttcttcctttgctgatacgggaatcaccttatggccgcagagctgttccagttcctctgtgcccacttccaaatccaaatccgatttattcagcagcacaatggatttcctgccctggatgaaatccatgatttccctgtcgctttcatccaggggcctggaaccatccaccacataaataatcaaatcagcgtccctggctgcctttaacgcccggtccacacctattttctccaccacgtcctctgtatccctgattccggccgtatccaccacattaagactgattccctgaagatatatatgctcctccagagtatccctggtagtacctgcaatctccgtgacaatagccctctcctcccctaaaagcacattcatgagggaggatttgcctgcattgggcttgcccagtatgactgtctttattccctcagacatgaccctgccgtcatccgccgacagaagcagctttctcacttcccctatcatgggttccagggaatccatcagctgtttcccgtatccgtccagggatatatgttccgggtcatccagggctgattcgataaacgcaatctgatacagaatccggctgcgcagctccttaatcttatttgacactgaaccgctcagctggctcacagagcttttaagcgcatattcattggttgcatgaattacatctgcaactgcctcggcctgggacaaatccagcctgccgttcaggaaagccctcttggtaaactctcccggatcagctgtcctggcgcccgcatgaaggacggtttccagaatccttctgaccatcaggacgcccccatggcagtcaatctccaccgtatcctcagccgtatagctgtggggtcccttcatgataatgaccagggcctcatccaccttatcatccccgtcatatatatacccgtaatggacggtatgggaccgggataggctcagccttaccctctccccttttttgttccggaaaatggaatcaataataaaaaatgcttcctcaccgctgattcgcacaattccgattcctgagttgctcatgcctgtggctatggccgcaatcgtatctgtcttcataggctctcctcacaatagagcaaaaaggccgtcgcttcagcaacagcctcttaacctgtttcattaccacctgcatccaatcatggttggacaggcttattcctcttcaccggcagctgtctcagcagacgcatcaacagatgtctgtgatgaaccatttccattgttccggcggttgcttctgtaacctccggaacggtcggaacgctcagagcggtcataacgtccgcccttatttctgtcgtaacgtccctttctctcaccgccggaagcttccttcttaagtgcaatcaccacatggcggaacggttcttccccctcgcttctggtggtcacatatttatcattctgaagggcagcatgaatgattcttctctcataaggattcataggttcaagagacaccggcctcttggtcctcttaaccttataagcaatattcttagccagggtctccagggtttccttccttctctcacggtaattctcagtgtccagtttaaccctgagatatccttccgttcccttgttcacaataaggcttaccagatactgaagagaatccagggtctggcctctcttgccaataaggatgcccatgtcctcgccttccaggtttaaggacagttcctgctcctcctggttatatgcagccgtaatgttcacttgcatattcattgccccaaaaatctgggacaggaaatccattgccttatcctcaacggactcttttttcttagcacgaataatggcaggttttgcgccgataccaaggaatcctgtacttcctttatcaactacctcatattccagtttgtcgctggtggtttcaagttcgattaacgcctttgtaactgcttcgtccactgtcttggcagtaactgtaatcatatccatacaaaaccctcctactttttacccttctcatgcttctcattatacttggaaaccatgttagccttagccgccagacttccgggcttggcattatcattatagtacttggtagactcctcaacaatggtctttgtcttagcaatcttagccatctgggcctgttctgccttttcttcctttgcctcaatcttcttgagcatctcatctacattgcccacttttgtaggaggaaggcctttctttgcgcgcttcttgttggttttttcaatgttcttctgaaccaggtcgtcaatattaaccttattaaggtaagaattgattcccacctgctggatgatggtgaacacactctgtgcaacccagtaaagtccgataccggatgcaaatgagaaacagaagaatacggacatcaaaggcatggtcacattcatgctcttcatcatattggcgccaggagcctcttcagactgctggggctggttggctgtcatcagcttggtgctgtaccactggcttaagccggccagcagcggaatacacagtgcagcgaatgcagtcatcagggtggtgtcgtctaccttattaaaataattcatgataacctgcagcggcgtgtatgcaatgttcaggccaaagaaattctgcatgttctcaatggcatccaccactcttacgcctgtctccgtaacagcctgtcccacggaggaaaaggcattgaccagagaatcccactgctgccctgtaagcttatataataaatcaatgactgtgtttacattggtatagtcaaatctctcacccaccattttgtgggcctgtgccaggtccgtaaatgcctgagccgactcatatccgctgggaagcttgcttaccactgcttcataatatccccttacggactgtacatatgcaggaatattgtagataacgcggtacaatgcgaaaataataggcatctgaatcagaagagggaggcacccgcctgtcatggatgtgccgtacttctcataaaccgccttgatttcagtctgcatcatcatggcgtacttctggtcattttccttgcccttgtactttttctggatggccgttatctcaggctgcataaccgccatgagtttcgatgatttctgctgcttgatggtaagaggtatcatcagcaccttggttacaagggtaaataaaatgatacataaaccaatatttaatatcccgaaggtactggtaaaacggaacaacaggtccataatccaccccaggatatcagctattggcccaagaatacctcctgtttttgtcaatactactgcgccagctatactgttcaatacgctacctcctttgatttacggaactggatcataaccgccttctgcaaatgggtgacaccggagtatcctcttgcaggccaaccatgtaccttttaacgcaccatacttctgtaatgcttcaatggcgtattgagagcatgtaggtgtgtaaatgcagtgagttcttactttaagaggcgacagaaacttctggtatcctcttaccaacaaaatcagatatcttgccataatcacttcacttcgattcttttaaaatgtgatgcagtccgcacaggtgcaggtaagcaccctccaaatgtttgtaatccgattgtccggcagcaactcttgctaccaggatgatgtttaacccagtctttatcctattattgtttaaacggaaaatctctcttaaaagccttgttatatgatggcggacaacactgttgcccacttttttgctcacagaaatgccaatgcggttttcatcttccccgttttccataatatacatcaccagcagtctgtttgcataggaagttccattcctgtaaatcacctggaactcactgttcttcttaacggaaggaaatcgtttcatccgaaactccttacaatcaggttgtcaaaacacttcccgttatccgggaaggtaagaaaagaaaaggccacatgttgctgtggcccgtagttcttttgctttaagcttgaaacaattaagcagataatcttgctctacctttagctcttctggcagcaataacttttctaccgcctgtagtcttcattcttgctctaaagccatgaactttcgctctctgtctcttcttaggctgaaatgtcatcttcatatccgggcacctcctatcaaaattatgtggcaatgtgaaaacacacatttagactagtataattaaacatcttctcaattatatagaagaaatccgccttcgtcaagcggattttctcaaaaaatcaacaaaaaaacagcaaaaaaggacagcctcaggggctgtcccaacaaaatgtgtgcattgcaaaactacattactatatttagtgtgaattcctgccggccaccagcctatggcctgctgtcagatgttatcttcagcagaattccggccacagccgtcacaatgattccggccaccagggcctcaggcactccctgcataccgatgatgcccaggattaccccgtatacccacttggctgtccagctggctgcggatgcatacttatctccaaacaaaagatagataagattcataacaagaagggtattggtcagggatccggccacgcctgccgcaaacaatgcggtcccctgcttattcctcttgttcccaagcatccgtatgaacatacggtacacataataggccacgaccccaatcagtattctcgggaccaggcagatgaacagacttcccaaatttccgtgaaactgccccatggtaacaaagggcgaaaacacaaaggatgtgggatttggcataaaggtattcttccacaaactggtcaggccgaatgtcaaccccagaaatgccccatatttcggtcccagtataatggctccgataatcacggggatatgaacggtggtcgcattcatgaatccaagcggaatataccctaagaatggcacaaaggccatgattacgataatggctgcaataactgccgccaataccaggtcacgggttttggttaaagtattcattttttcctcctgctactgttcttatgaaaaagatacaatgcaatgctacaacgtaattataagtaaaaaagacctcagcgtcaatgtttcaggttcatgtttccctttctatgcaaggacattttcacattagcccccagatttacataacattatccacaaaatgtggataagttgtggataagtatgggatactcactgttttttccccaggcctatctaaaaaaaccagaatttattagtatttccaccatgtgtaaaactccggttaactttttcacgatttttgtggacaaatggcctgtccacagggcttacacagatcttccactcacaatacacaaagttatccacaatattttacacttgtcattgaaaaaatttttactttagtatacaatagatttagattgggcaattctgcaatacagttttaggagacaaaaaatgatcgaaaaaatcaaagaaaactgggacaaaatcttacttactttaaaagaagaacacgaaatatccaatatctcctacagtacctggctggaacccttaaagccgcactcttttaaagacaacaaagtaaccatcattgttcccgaacagacctttttacaatatgtaaacaaaaaatatggatttttattaaaggtaaccatctcggaattccttgaaaaggaatgcgaggtggatttcaaagttaaggagcaaatcgaggaggcggaggaaccgtcctccccccagctgattaagaacaacaaggctttagtgagtcccgatgtcatacagagcgcgaacttaaatcccaagtatacctttgatacctttgttgtaggcggaaataacaacctggcccatgctgccgccctggctgtggctgaatccccaggtgagatttacaaccctctttttatttacggaggcgtgggacttggcaaaacccatctgatgcatgccatcgcccacttcatattaaagaacaacgccaaatccaagatattgtacgtcacctctgagacctttaccaatgagctgattgacgccatccgtaataagaacaacataaccaccacggaattcagggaaaaatacaggaacaacgatgtcctgctcattgacgatatccagttcatcataggtaaggaaagcacccaggaggaatttttccataccttcaacacattatatgaatcaaagaagcagattatcatatcctcagataagccgccaaaagaaattgagacactggaagaacggctccgctcccgtttcgaatggggcctgaccgtggacatccaatctcctgattatgagacaagaatggcaatcctgcgcaaaaaggaggagatggagggatataatatagataacgaggtaatcaaatacatcgctaccaacattaaatccaacatccgtgagctggagggagccctgacaaaaatcgttgcattatcaaggctcaacaaatgcgacatcaccctggagctggccgaggaagccttaaaggacatcatttcccccaatgcccagagggaagtgacccctgacctgataatccaggtcgtttccgaccactttggtctgaccccactggatatttcatcccagaaacgcaataaggaaatcgtatacccaaggcagattgtcatgtacctgtgcagggatatgacggccaccccactccagaccattggacggtatcttggaggaagggaccataccaccatcatacacggcgctgaaaagattaccggggacatggcaaaggacgatactttaaggaataccatagagatattgaaaaagaagattaatccacaataggaagtggaatccatgtggacgggctgttgataactgatcgtttctgaaggacctgtgaatgacttttaaccatctgtggataaactttaagttttccctgagaaaagtggatggtttccacagcccgttccacaggtacttgtccttaattatcaagggcttcagacagttttgcacaaacccacagcccctactacggtttctacgaaaattatctatatcttcactcacagatgacacaccgggcacacaattactctgaaaggaagttatcaacattatgaagttaagatttcaaaaagacgccattgttaatggaattaatattgtaatgaaagcagtaccttccaagaccaccatgtccattctggaatgcatactcattgacgccagtacaaacgaaatcaagcttacaggcaatgatatggagctgggaattgagacaagggttgagggagacatactggaacacggaaagattgcactggatgcaaagcttttctctgaaatcaccagaaggctttccagtgaaaatgcatccgttaccattgaatcagatgataagttcaacaccaccatacgctgtgagaactctgtatttaatatccagggacgcgacggagaagagtttgcctatcttccctatatagaaaaggataaatatatctgcctgtcccagtttaccttaaaggaggtcatccagcagaccatattctccatttcacctaacgacagcaataagatgatggccggagagctgtttgaggtcaatgaaaaccagctgaaggtggtgtccctagacggacacagaatctccatccgtaaggtccgcttaaaggaccactatgaggacaccaaggttattgtaccgggtaagaccttaagcgaggtcagcaaaattttgggcggcgacaatgagaaagaggttctgatttacttcagcaccaaccacatcctctttgaatttgacaatacaatcgttgtgtcccgtctgattgaaggggaatatttcagaatcagccagatgctttccagtgattatgagacaaaggtatcggtaaacaagaaggaattcctggactgtattgagcgcgccaccatcctgatacgcgaaaacgacaagaaaccgctgattatcaatattggcgataattccatggaactgaagctgaactccagttttggatccatgaacgcagatttgatgattcacaaaaccggtaaggacatcatgattggattcaatcccaagttcctcatcgatgcactgcgtgtcattgatgacgaggaaatcaatatttatatgatgaatccaaagtccccatgctttatcaaggacgaggaggaaaattatatttatctgattcttcctgttaattttaatgctgctactgtctagcaggatgtctaagagaggaaaagtatggaaataataaaactgagggaagactatatcaagctgggccaggcgctgaaggcggctggcctggcggaatcaggcgtagatgccaagtatgctattgaggacggccttgtatcggtaaacggcgagactgctcatcagcgcgggaaaaaactggtggacggcgatgtggtcacctataacggtgaaaccattaaaatcactaagtaacagactggtagggaaatccatgattattgaatccatagaactgaaaaattaccgcaactacaatgaactacatatggagtttaatcagggaaccaatatactctatggggataatgcccagggaaaaaccaatatcctggaggcagtgtatgtgtgctgcacgtccaaatcacataaaagcgccaaggacagggatatcatccggttcaatcaggatgaatcccatattaaattgcagataaggaaaaacaatgtaccttaccgcattgacatgcatctgaaaaagaacaagccaaagggcattgccatcaatggggttcccatacgcagggccagcgagctgttcggcattgccaatgtggtattcttctcgccggaggatttgaatattataaaaaacgggccttctgagaggagacggttcattgacatggaactgtgccagctgaataaactctatgtccattcccttgtgcagtacaacaaggtccttcttcagcggaacaagctgttaaaggaactgtttttcaggcctgaatacgaggaaaccctggatgtctgggatatgcagctggtaaattacgggcgtgaggtaattaagttccgaagggaatttattaagcagctgaatgaaatcatgcacgccatccacctgagtctgacaggggacagggaggatatatccatttcctatgaaccctacacccaggaggaccagatggaggatgtccttaagaggaaccgtgcccaggacatgaaacagaagaccacattgtcgggacctcacagggacgacattagctttattgttaatggtattgatatacgcaggttcggatcccagggtcagcagcgcacagcagccctgtcacttaagctgtcagagcttcagctggtcaagcaattaagccatgacgacccaatcctgctattagatgatgtgttatcagagcttgacagcagcaggcagaatcatctgctgtcggccatcaaacatatacagaccatgattacctgcacgggtctggacgattttgtcaacaacaggttccagatagataaggtattcaaggtaattgacgggactgtcatcaacgagaattaatgccgtactagaaagaaaggatgattatataacatgggagagcaatacggagcagaccagattcagattttggaaggactggaggcggtcagaaagcggcctggtatgtatataggcagcacatcagccagaggtctccatcatctggtgtatgagattgtagataatgcggtagatgaagcattggcgggatattgtgattccatcgatgtgaccatcaacgaggacaattccatcacagtggtggacgacggccgcggtattccggtagatatccagaaaaaggcgggccttcctgccgtggaagttgtattcaccatcctccatgcaggcggtaagttcggcaacggcggatataaggtgtccggcggtcttcatggcgttggtgcttccgttgtcaatgctttgtctgaatggctggaggtgcaggtatataaaaatggaaatatttaccagcagcgttacgagaggggaaaggtaacataccccttaaaaattgtgggaaaatgcggaccggaacagcatggaaccaaggttacattcctgcctgacaaggagatattcgaggaaacagtctatgattacgacacgctgaaaatccggctcagggaaactgcgttcctgaccaagaacctgaggattacccttaaggacgacagggaagaaaagaaggaaaagacattccactatgagggcggtatcaaggaattcgtcacatacctgaataagggcaagacacctctttacgagcaggttatttactgcgagggaaccaaggaaggcgtgtatgtggaagtatccatgcagcacaatgattcctatacagagaatatctatacatttgtaaacaacatcaatacgcctgagggcggcacccatctcaccggtttcaagaacgccctgaccaagaccttcaacgattatgccagggaaaacaagctcctaaaggacagcgaggataacttgtccggtgaggatatacgcgagggcctgacagccattatcagtgttaaaatcgaggatccccagtttgaggggcagacaaaacagaagctgggcaacagcgaggcccgtgcggcagtggacaatattgtcagtgagcagctgacctatttcctggagcagaatccggctgtggccaagtccatgtgcgagaaatccatactggcacagagggccagggcagctgccaggaaggccagggatttgacgcgccgtaaatccgctcttgacggcatggctcttccgggaaagctggctgactgttccgacaaaaatccggagaactgcgagatttacattgtagagggtgattccgccggcggttctgcgaagacagcccgttcccgtgcaacccaggccatccttcccctgcgcggtaagattcttaacgtggagaaggccaggatggaccgtatctacggcaatgctgaaatcaaggccatgataactgcatttggaacaggtatccatgatgatttcgatatatccaggctgcgctaccacaaaatcatcatcatgacggatgccgatgtggacggcgctcatatcagcacccttcttctgacatttatttacagattcatgccggaactgattaagcagggatatgtatacctggcccagccgccgctttataaggtggagaagaacaagagggtgtggtatgcgtacagcgatgaggagctgaattccatcctcatggagattggccgggacaacagtaataaaatccagcgttacaaaggtctgggagagatggatgcggagcagctgtgggagacaaccatggacccggaacgcaggattcttctgcgtgtcaccatggacgaggaaaccacgtcagaagtagatttgaccttcaccacccttatgggcgaccaggtagagccaagaagggaattcattgaggccaatgcaaaaaaggtgaagaacttagatatctgattttagactgcaaacataaaggagattgaatatggaaccaaatgtatttgacaaggttcatgaagtagaccttaaaaaaaccatggaacagtcctatatcgactatgccatgagtgttatcagcgccagggccctgcctgatgtcagggacggtcttaagcccgtacagaggcgtgtgctttattccatgattgagctgaataacggtccggataagcctcatcgtaagtgcgcccgtatcgtcggtgatacaatgggtaagtaccatccccatggagacagctccatttacggcgcgctggttaacatggcgcaggagtggtccacccgatatcctctggtggacggacacggaaactttggttctgtggacggagacggcgctgcagccatgcgttacacagaggcccgcttaagtaagatttccatggaaatgctggcagatatcaataaagataccgtggacttcgtacccaactttgatgagacagagagagaaccccttgtacttccttccagataccccaaccttctggtgaacggtacatccggtattgccgttggtatggccaccaatataccgccccacaacctgagggaaatcatcggagcagtggtgaagatgattgataacagggtggaggaggaccgggaaacctccctggaagaaatcatggagatagtgaaggggcctgacttccccaccggagccaccattctgggaagaaggggaattgaggaagcctaccgaacaggccgcgccaaaataaaggtgcgcgcagtgaccaacatagaaaccatggccaacggaaagtccagaatcattgtgacggaacttccctacatggtaaacaaggcccgtctcattgagaaaatcgcagatttggtcaaggaaaagaaaattgacggcatcacctatatcggagatgaatccaaccgtgaaggcatgcgtataaacatagagctgcgcagggatgtaaatgccaatgtaatcctgaaccagctgctaaagcatacccagctgcaggataccttcggcgttattatgctggccctgattaacaaccagccaagggtgctgaacctgcaccagatgctggaggagtacttaaagcatcaggaagaggtcgttaccagaaggacacagtatgatttaaacaaggcggaagaaagggcccacatattaaagggtctgctcattgccctggaccatattgatgaggttatccgcattatccgcgggtcagccaatgtggctgacgccaagaaccagttgatggagcgcttcggactttccgatgtccagtcacaggctattgtggatatgaggctccgcgctcttacggggttggaacgtgagaagctggaaaatgaattcagggaactgcaggcaaagattgaggagttaaaagctattcttgcagatgagaagaagctgcttactgttatccgggatgaaattatgattatctcggataaatacggcgatgaccgccgcacagccattggatatgacgatgatatgtccatggaggatttgattccggacgaggacaccatcattgccatgacccatctggggtacatcaagcgtatggatgtggataatttcagaagccagaaccgcggaggcaagggcatcaaggggatgcagaccattgaggaggattatatcgaggacctgctcatgaccaccaaccatcactatatgatgttctttaccaataccggccgggtataccgtctgaaggcgtacgagatacctgaagcagggcgcacggccaggggaacggctatcataaacctactgcagctgatgccggaggagaagattacggccatcattcccatgcgtgaattcaacgatgacaaatatctgttcatggctaccaggaacggcatggtcaagaagacgcctatggtggagtatgagcatgtgcgcaaaaacggtctgcaggccattgtgctccgggacggcgatgagctgatagaggtaaaggcaacggataatacccaggatattcttcttgtcacacgaaagggcatgtgtatccgcttcaatgagacagatgtaagggtgaccggccgtgtgtccatgggcgtcatcggaatgcggtttgaggatgacgatgaggtcattggaatgcagatgcagagccagggagacagccttctggtggtttccgagaacggtatgggcaagcgcaccatgatttcggaattcagtgcccagaacaggggcggaaagggtgtcatctgctataagtgtacggataagaccggctatctggtaggggccaagctggtaaatgacggcagggaaatcatgataataacaacagagggcatcattatccgcatgactgttgacgatatatccgtgattgggcgcaacacctccggcgtcaagcttatgagcattgaccaggaatccgacatcaaggtggcaagtatagccaaggtaagggaaagtgttaccaaggacagcaatgtatacgatgaagagtattacgaggaagagaacggggattctgaggaagaaagcgaagcagaaacagattcagatgaaacggtttaagattcagttccatgaaaaggctgtcagtcacgacagcctttttatgaaatagttattgcgtttctgttcccttacctggttacggacaaaagaggagaaccgaacaatatggttatgtggtcattggcagcagagttattaggacttattattcacattatactcattttataccattacgaacggcggctggtgtccagcaacaggcggaaaatctatcaggtatgcctgtggatttctgttgcaaccatacttttgaatattgtctgcgtacatatggttacacatccgtttacggtttcccgggggatgaatgtgctgtttaacagcctgtattttattttatgcgtactaacctgttcggttatggcagtctatatgttcgccctcacattggagcatgtatataataagcattgcctgaggatggcaggcggcattgtacttattctaaatattatatttctgggaatcgtactatggaaccttaaaagcggcgtgctgttttacttcggtgaaaaccggatatacagaaggggcccattaaacagggttggctatctggttatggccattgagatgctcatgctggtggtgtgctatatgcgcaaccgccgcagtgtcagcaggccggtggtccgcttaatccgcaccatgcccgtgattgcggctatctgtattgtgttccagcatatatataaggaccttcagttaaacggcatgttcatggccattgtcaatatggttatatttatcagcttccagaccaggcgaagcgaggtggacagccttacctttatcggaaacaggaactgcttttttgaggagatatcccttagaatggccagcaggcagtattttcaggtggtgcttgtatgcctgaagcagttctcactgattaatgagaaattcagctataaaaagggggatgagtttttataccgcattgccggggagctggaccatattctgccgggggcaaaggcattccggtttggaaatgtggagtttgcagtgcttcttccctatggcacggaagaagagaccctttgcagccttaaaaggatacaggaacgttttgaggacaaatgggagctgggagagctgggcagttatatccaggcgtattttacagatgtggtatacaacggccagggatggagcgccacccaaatcatggagtacctggaatccggcatccattatgccaaaagggagccgggaggaatgaggcggtttgatgcagaactgctggagcagttaaacagaagaaagcggattctggatatcatggagacatccatccggcaaaggcgatttaaggtatggtaccagcctgtttttaacctgaaaacaaacaggttctcatcagccgaagctctgctgcgcctcagggactatgacggcgaaccggtatctccggctgaattcatacccctggcggaagaaacaggtctgattgacgacctgagctggattgtgctggaggaagtctgtatgcttcttggacatatgtccggccaaatagattccatttccatcaatctctccatgcagcagtttgaggaccgcaatctttccggtagaatcaatgcgtgtctgaaacggtccggtcttagcccggataaactgaagattgaggttacggaacgggtcctgctgcaggatatggattatatgagaatgataatggaggaaatgacaggggaaggctttggtttttatctggatgatttcggcaccggatactccaatatatcctgcgccctgtctcttccctttgagtatatcaaactggacagaagtcttttggtgcgtctgcctggggacaccaaggtccaggtattcgtgcggagcatgatagagacattccatgcaatgggacagaaaatcgtggcagaaggcgtggaaaaagaggaacagatagaaatattaaggcagttcggcgtggactgtgttcaggggtattattacggaaggcccatgccggaagatgaatttaaggatattatagcaaaaggatgggaggagcaaaggaaatgagggagatatccgcagcagccataacagaagcagtaagagatatgtgtatggaggccaattatggactggccccggacatgaggaaggtatttgaaaaggcagtggaggaggaggagtcccctctgggccgtcaggttctgggacagctcaaggagaatctgagaatcgcgggagaggacagcattcccatctgtcaggataccggtatggccgtggtgttcatgaaaataggccaggatgtacatataacagggggaaggctggcagatgctgtcaatgagggggtgcgtcagggatatgaacagggatatctgcgcaaatccgttgttggggaccccatagagcggatgaatacaaaggacaatacgccggctgtgattcattatgaaattgtggacggggaacagatggatatcacagtggctcccaagggatttggaagtgagaatatgagccgggtttttatgttaaaaccggcagacggcctggaaggggtaaaggcatccattctacaggctgtgagagacgctggtcccaatgcctgtccgcccatggtggtgggagtgggcataggggggacctttgaaaaatgtgcagagatggcaaaacacgccctgaccaggaatatagaggataagcccgcaaagcagtgggtcagggagctggaggaagatatgctaaacagaatcaaccagtcaggcataggaccggggggactgggagggaggattactgcccttgccgtgaacgttgagacctttgccacccatattgccggtcttccccttgccgtgaacatatgctgccatgtaaaccgccatgcccgccgaatactgtaaatagagaaaggagtcctgttctgatgaaccgacatatgaatgtaccaatgacaaaagaggaagctgcttccttaaaagcaggagattatgtatatcttacagggaccatttacacggccagggatgcggcccataaacggatggatgaggcgcttgaccgaggggagacactgccgtttgacatagacggaaatatcatatattacatgggtccgtcccctgccagggagggaaggcccattggctctgccggtcctaccacggccagccgcatggataagtatacgccccggctgctggatttgggcatgggagccatgataggaaagggaaagagaagtaaggaggtcatggatgccattgtgcgcagcggtgctgtttattttgccgctgtgggaggtgctggagccattctgtccaaatgtatcctgtcgtctgaattggttgcatatgaggatttgggcacagaggcagtccgcaggctgactatccgggattttccggtggtggtggtggcggatgcttttggtaataatctatatgaaacagcagtaaaggaattttgtactctgtagtgaggggatatgaagcggattatatatatggtactcatgaatcttttccatgctcctgtgtggttcttcaccattgcccggatggccagggaggaggacacaaggacagccgctgagaagtatgggtatatatcggagatggtaaaaaggataaacaaaaggggaagggttacggtcacggcttcgggaacagagcacattccgtctcaggatggattcatactgtttcccaaccatcaggggctgtttgatatgcttgccctgttttcaacatgcccaaggccgctgtccgttgtaataaagaaggaggcgtccaactgggttctggtaaagcaggtactgggggctaccagaagccttgccatggacagggatgatataaaagaccaggtgcgcatcataactgaagttaccagactggtaaaggcaggccgcaactttgtcatatttgcagaaggacaccggagccgcaagggaaatgagatactggatttcaaaagcggtacatttaagagtgcagtaaaagcagggtgccctattgtgcccgtagccctgattaattccttccggccctttgatatgaactcattaaagagggaggaagtacaggttcgctatatggagccaatcctgcctgatcaatatatgggaatgaaaacctcagaaatagcacatcttgtacatgaccggattcaggaagaaataaataaaaatctctcccaaaatggcttgacaagctaaagtctatttagtataatggtcaatgcgtctgagggcaagcatgtccaaagaagcaatcatatggaaaatatcaattcggagaaatactcaagaggccgaagaggcgcccctgctaagggtgtaggtcgggaaaccggcgcgagggttcaaatccctctttctccgctccattttccaaatgattatttttttcactcttgttaaaaagatgaaaaaaagttttaaaaagttgttgacaataaacgacagtcgtggtatagttaatacccgctggagaaaacaacaacagcggttgatgattggaaaaggcctgcgggctgaaaacaaaaatcaaaaaaataaaaaaagttgttgacaaacacttgcaactgtgataagatataaaagttgctgctgaacaagccgacaacaaagaaccttgataattgaagattagacagtatgtaaaaccctgaaaattctaaaaacaaaaggtctggtttagacctttggatttgagaaaattcagaacaaaaccaagtaatgaaggttaaagataactagccaagctaagtagtctgaaacctggaatcaacttttaaacatgagagtttgatcctggctcaggatgaacgctggcggcgtgcctaacacatgcaagtcgaacgaagcaattaagaggaagttttcggatggaatcttgattgactgagtggcggacgggtgagtaacgttactcacccgtccgccactcagtcaatcaagattccatccgaaaacttcctccgattgcttcgttcgacttgcatgtgttaggcacgccgccagcgttcatcctgagccaggatcaaactctcatgtttaaaagttgattccaggtttcagactacttagcttggctagttatctttaaccttcattacttggttttgttctgaattttctcaaatccaaaggtctaaaccagaccttttgtttttagaattttcagggttttacatactgtctaatcttcaattatcaaggttctctgttgttgtctgcctcagcagcaactttgatagtttatcatatttgcaactgtttgtcaacaacttttttatttcttttttgtcgtctgtctcaacagcaacttttatatattaccacatctgtcactgtttgtcaacaactttttcaactcattttcaagagctgtcccaccgttttgcgcggtggacctttaatatatcactactttcgcaacttgtcaagggaatttgtgccatttttttatacaattttcaactttattttcccaccactaaatatgcttattttttctgtatttttctatattttgtggttaataaaaaaatcgctgtttacagatgtttccatcccctcccagcgatttgttttaattatatatattataggaacaattatacctttttcttctatagaatgccccggataatgccgcccagaataatattaatcagattgtactgatgtaaaaaacgcagccaggcacttgcattgatttgttcctccaatgccatacccaaaggcgtggctgcaaagattcctaccagaaaacagccaatccacagcagaagcagcccctgaaccagccccagtacagcgccggctatgtgatttaatccatacagaatgggcagccgcgcaataatatccagccaccgcaccaccagatgaatcagaatatagacagctgcaaacaggatgatggaactgactgcattgataaggatgtcagccagatatgtgctgacgtattccgcaaaccggtccactcccagcaaatgataaaattcgctgttattgttctccagcagcatttcctttacggattggggcaggttcagattctcaatggcaatgcgctgcgctgccggcatttccgttgcttcagcgggcagttcttcccagcccgctgcattcagtatggcctccgccgcactctggcgtatggagggattgtctttgataaagcccgtcatatacggcgtggccacctttactaatatgatggtaagtatcagtgctcccagggatacacactgcttcagcgctcccctgtaatgcccatacagcaccatgccggcgagaaaaactccggcaccggcagacagccagtgttctaatatcatgtccatattgtttcagtctttcttttagttgaaaatcaagcgttctatggcgtctgcaactccatcctcgtcatttgtcagcgtaatccggtctgccgcactcttagctatgtcaagtccatttcccatggcaacgcctactccggctgcctccagcatggaaatatcattttccccatccccaaatgccatggtggccccgggagcaatcccaagataatccgccagccacataagcgcatttcccttcgtagctcccagggcattgatttccagattgttatacagggatgagcttatgacaatgccctctacagcagagagctccctgcgcaggggcactgcgtccctcacatcggacagatatacgttgaccttctccacgtctttcccgcagtctgtcacatatttcaggatattgggcacaacgtccctggtggagagtaccattttctgaatcacagagctcagaccgtagtcctccatatgctcgatgaactcaggctgggaaattccccttccgtctatatacgggtcgtacattgccctgtatttttttacaatatccatgacttccagcgcctttgcattggtcagggtacaccgtttcagactggttccttttacaaggtccgccacagtaccgccgttggtggttatggcataattcactcccggcagggaccgtactgcttccgttataccatccacagccctgcccgtggtcggtactatctggatacccatgccggcacagcgttccagcaccctgcggttgcgctctgacaggttcttctggctgtccagcagagtgccgtcaaggtctagtgcaattaaacctatggtcatcatataaaatgctcctcttttaatatcagaagaccgtccctgtcatacttggacgagaatattcctgtaatccgcttaaagaaggatggattctccgccttatcagcagcttcttctatcaagtcttcggcatttacctttgtaagcggtatgccgtcctcctccatgatttcaatccgctcatagagggccagcatgctttttcctgatatgctgcagtcaatgtcgctggcatactgacatgcgtactgggcaaactcgtcaatatccatctcctgttggtcgtcatactccggctcttcctgctggggaaggaccggcgcattatcctctgcttttgaaggaagttccttctttggaagagatgccttcaccgcctccggtttctttgcctttggttcctcttctttgtgttcttccctgcgggcagctgttaccgagcggacctcttccggcttcctgcgtaccggctttggcttctgctctgcctctggtttcggcaggctctttggaacctctggttcctgaacaggctgaaccttccccgtggctggttccgcggagcggctctggacctttttgggtacagccggctcttctgtcctgcgaagctgcaccggacgcacagggcggtcatccccctccggcgccacataggcaacctcctccggtcccatcttccctacatactcaaaccgtttggctaatcccggatataccttgtgaatacgggccagattaccagccacatctataaggaccacattcatgccggtctcatccctggccatcagctggttcagctcctggagggtggattcctccatggcgcccgcctgctcaataatcaggtccttgcccgtcagtttgtctgcaatggcaaatacccctttgctgttaagcttttctcccgttatcttggcagcctggttcttcgctcctgtctccttgtgaatcttcttgagcagttcgatggcctggtccaggcctgagctggaatactctgcttctatcatgaaatgatgcgactcctggacagatgattctttccccaaatcttttatgtcggtcagcacccgtgtctgggcagacgttgtttccggcctgtgccgtccgtctgataacctggacatttctctggccagatttgcctggacctctgcttcatgcatcctggcccggaccgcctcatctgacagaatctggggcttatccggcatccactgggactgtccttcctttacaggctcctctccctcatctgaatcctctggctctatggtaacctgggtatgggcgttctcgtcctcatatggttcctccgccccggctccgtccccctggtcttcctccgtgtatccggcagcagtgttttcttctgcatcctcccgctgattccggtcaggataatcatttccgtaatacccctgccttccatatgcttcctcagagtcatcctcttccgggtatgggtctgcatgatatccggtctgcccattttcatcttcgtgatatccgcgttccggatatccgccctccccataaccgtcttctgcgtatccactctcctgatacctgtcctgcgcgtacccggccttctgatatcctccctgtgggtatccgctttcctgatatccgtcttccgcgtatccgctctcctgatatccatcttccgcgtacccgctctcctgatatccgtcctgcgtgtacccggccttctgatatcctccctgtgcgtacccgctctcctgatatccgtcctctgcatatccgtcttcctgatatctgtcctccgggtactccgcatccggctccacggcaaaggcagcctcccggcgggccatataggactggggggagacttccgtctgcctctcaggcatgggctcatagtcagccggccgttttccggcgcggtactcctgttccacggccttgaggcgggcctcatatttatccctgttctccaccaggtccatctggtactttgtcaggggtgcaaactgaatcttaagctccatggccttttctacatatttccccaggccgaacatgagcatgattttgtcgcaggccatgacgcagagttcccccataccagcctctgcatacaattccgccagctcatagagccacttttcatccagctcaatgttgcagtactgctccagggtatgaatcagctgctctgcaggcgccccctttgcccccagaatcaggtaacgcagaatatactgcctggggtcatccggcgccaggtcgcagaattccctgtaatagtcctctgcctcctgaaagctgccttccttaatcgccagctccgccagcttgaacagcaggcgtttccctatgggcgcccgctcaaatgccagcagcaggatgtccttggcctcctggtactcttcgttcttctcatagatggttgccaccatggacaggatgtttacattccgcaccctgcgccagtctatggtatcagcaatcttcatggctgtctcatagtcgccgcggcttaccatcttcttaatctgctcaacctttatgttaaactcgtatttatccatcttttgcatctccctatcgctagttcccggtatggaaatctgctgtctaaagttccgtcctgccttccaatgcccgaagaagtgttacttcgtctatgtattccaaatccccgccaacgggtactccgctggcaattctggtcactttaatccctgaaggctttatcagcttgcttatatacatagccgttgtctcgccttccaggctggaattggtggcaataatgacttcctccacatccgactggagcctttgcatcaattccttcagctttatatcccccgggccaatccccagcataggagaaatagcgccatgcagcacatgataaaccccatcgtatttgccagtcttctcataagcagccaaatccctggtattttccaccaccataatggtcttatgattccgcctttcactgctgcagatagggcacagttccttatccgtcaaggtgaagcattccttacaataacgtacgttattcctggcgcttgtcatggctcccgccagctcctccacctgctccttcggcatgttgataatatggaatgccaggcgctgggccgacttggccccaactccggggagcttggacagttcctctattaacttggtaatctgactgctgtaataatccattagaagggaaaacctccgcccagggctccgcctaaaccgcctgtcagcttagacatggcctcgctgctctcagcctccatctgacggaaagcctcattggtagctgccacaatcaggtcctctaacatctcaatatcgtccggatccactacatccggagacagcttaacggaaaccacttcctttttgccggacacggtcacgctgaccgcaccgccgcccgaagcagctgtgtattccttattctcaagctccttggtcgtctcctccatctgccgctgcatacgctgcgcctgcttcataagattattcatgttgccaggcattccgcctgaaaatccgccacgttttgccatggtgtattatcctcctatcatttccatttattcatctttctattattcatcttcatatgtaatatccatatgaatcttttcttccaattcttcctgggtcacgtaaatcgtattaagccgctccccgcgtccggccagtctggtcttaaagtaaatggacctgccgaaatttgtttccacatagcgttccagctcccctataacggtgggccgtttgcccatatcatagctcatggaatccatgaacacaatggtcaggcatccttctccgccaggctccaccacggtatccctgagataagacttggctccgcctcctatgctgcggacaatcttggcccattcgttccgcaccagttttaagtcttccagctgggcctggggcagggctaccttttccggcgggaccccggggtccgcctgaagccccgcagcatagggcgctgttatctggggcactgctcctccgctcagaggcatggctccgcctgtctggggcggtccaccgggtatgcccccagacatctggctgacagccgctgccggaatggccatgcggcctgcttccaggtcctccatctgggcttccaaatcccccagccgctggagaatggcatccaggttaggctccatggaggggcgcgtcagcttaataagcgccacctccaccagcacccgcttctggctggcatagcgcaattggttggataattcggaaaaaatacggatataccgcatcagcgtgtttccgtccgccttgcctgcatcgcttctcagctgttttaaattctcctccgacatatccaccaggccttctgcatcgtctgcactctggattaaaaggagatttctcatataccatataaaatcagtgacaaactggcccagctcccgcccctgaatcacaatatcctccagcctgcatatacagtcctttgtcctgctctccacaatggcgccgaacatctggctgaacacgctggaatccactgcccccaaaacctccagggcattgtcataggtcagcacctttccgtaatgaaaggccacgcactggtccaaaaggctcagggcatccctgagcgagccgtctgccgcctttgccacatagagaagggccttgtcctccacctgaatctgctcggcccgggtcagctccctcaggtggtccgctatggtctctagggatatgcgcttaaaatcatagcgctggcagcgggacagtatggtaatgggaatcttgtgcacttctgtggtggccagtatgaaaatcacataggagggcggttcctccagcgtcttcaacagggcgttaaaggcgcctatggaaagcatatggacctcgtcgatgatatataccctgtaacgtccctctgtgggaggatactgcacctgctcccttatatcacgtatgttctccacgccgttgttggaggcggcatcgatttccaccacattcatggaggaacctgcctggatggacctgcaggtgggacattcgttgcagggacttccgtctgccggatgttcgcagttcactgccctggcaaatatcttggctatactggtcttacctgttcccctggtaccgcagaacaggtaagcatggccgattcgctccgacgttatttggtttttcagtgtctgcacaatcgggtcctggccttttacatcttcaaaagaaacaggacgccacttgcggtataacgccgtatatgacatgttaggcaactcctattattctatcttgatatgaatttattttcttattcatcgccaaagctgatacccaccatcttggcttccttaatcatggagcactccgggtccacggtcttaagctttcccgccacctcagagaggggtaccctggtaatatcgttgttcttcaccgccaccatgtagccatactgttcctccgcaatcagcctggctgccgcagcccccagcctggttgccagcacacggtcatacgagcatggttcgccgccgcgctgcatatgtcccggaacagttacccttacctcgctgccgatgacttcctgtatcttggccccgatttcataggccacggaaggatataccactccgcttttcttcttttccttcagttccttcttgctcatcttggcatcttctttggaaatggcgccttcggccactgccaggatggagaagcgcttgcctgccttggacctcttggtcagggcatcgcatacaatgtttatatcatagggtatctccggaagaagtataatgtccgccccgcctgcaaggcctgcatacagggtcagccatcccaccttatgtcccatgacctccacgataaacacgcgtccgtgggacgctgccgtggtatggatacagtcaatggcattggtggccacgtccaccgcactctggaacccaaaggtcatatccgtgccccagaggtcattgtcaatggttttgggaagggataccacgttaagtccctcttcgctgagcatgttggctgtcttctggctgccgtttccgcccagcactacaagacagctgagcttcagctttttataggtgtgcttcatggcttccaccttatccagtccattctcatcaggagtgcgcataagcttgaaaggctggcgagaagtgccgaggatggtaccgccctgggtgagaatacctgagaaatcggatgatttcatgatttgatagtctgcatacataagtcctttatatccgtcttcaaagccaatgatttccacgtcgtcaaacatgttgtataaggactttgccacgcctctcatggtggcattcagtgcctggcagtctccgccgctggtcagcattcctattcttctcatattgcacttcctccttatagagttgcttcactttctgttatgtttcctgggaatggttctattatacccattttgtaattataacgcaaaggtgttatcggggcaagtataaattcggacaaccatccatcctgcaaccgccccgcctgtcagccccgcagcatcagcccgacggctgtgcatcagaacagccgcacgccattctgaaatacaaatgggacataaatccggtgatacagtaacgtatcctcagatttatatcccatttttaaattccacgcaccttgctttgtgctgctgccacgaacgttactcatacagttaactcaatccaggctgcctcacggcacacgggaggttccgcttagtgctgctgcattcctgccctgacacggttcacggattcccgttgcgtaagacccagacgtcaacgccacttacacaaggcagcttcgcagcaaacagcccgaggcaaggtatcacccctgctggagcggattgcaggtacagggcaccgctatctccccggctgcgtggaaactttatgacatattaggccgtacatacgcagatgtatcaacaaatgcccacacgggcagttgttgaaaactgcctgttaagtataacctgccggaacgcttttgtcaaggctgtgcctccaccaaaaataacctggacaaataatccccctggggcacagggctggtccgtacgccgctggccccgtccgacagaatcaggcctgcgctcatgagctcgtccccgtagcaggtatacccaagcccgctgacccggtacattgtctccggtctcaatcccctgaggaccagccgcttaaagccggtgtttacaggctgcaggaaccggaaatacgctgccatggccttgtttccatcctccgataccacaatccacgcagcctcatttccctcaaagggacttatgagccggtaaaaccttccctgctgaatcagttttctgtgctccttcatgaaccgcacctgttcctttacctggtactgctcctcctctgtaagcaggttcaggtccagttcatacccaaaggtgccgaaataagctgccgctgccctggacgccaaaggaacattccgccgggtctggtggttgggtatggcggacacatggcttcccatggagctgacgggatataccagactggttccgtactggatttttacccgctccactccgtcggtatcgtctgaaacccagccctggggagcatagtacaggatgcccgggtcaaacctggcgcctccgctggcgcaggactcaaacaggacccgggggaaatccctggtaagccgctggtaaagcttatagacccccagtatctgcctgtggtaaacggttccctggtactgcgcatcccggccggctgaaaaaaggtcggaaatactccggttcatgtcccatttcacataggatacaccgccgtctcccagtatctcctccatcctgtccccaatataatccaccacctggtcctttgagaaatccagcacatactggtgccttcccgtgcacaccggccggtccgtgctccccagcatccagtccggatgggcgcggtagagccggctttcccggctgaccatctccggctcaaaccacaggccgaacttcatccccatattcctgatttttcctgccagtcctgttatcccgtccggcagcttatgaaggtccggataccagtcccccagggaggtagtgtcatcgtcccgttttccaaaccacccgtcatccagcacaaacagctctatgcccagctcccttgcctttcctgcaatggaaagaatcttttcctcgtcaaaatccataaacgtggcttcccagttattaatcagtatgggcctctcccggtccctccagtatcccctggcaagcctggtccggtagagccgatggaacacctggctcatactgtttaagccctctgcagaatataccatcactgcctccggcgtctggaattcctcccccggataaaggggccagttaaatccctccggatgaattccaatggtcacccggaccgtgtccatggtgtccacctctgcctgggccaggaaattgccgctgtacacaaggctgatgccaataacctcgccgctgtcctcccctgcatcaggccgtttcaggcagataaagggattaaactggtggctgctgtgtcccctcatgctgtgaatgctctggaccccctggtgaagtccatggacatccatataccgttccctgcaccaggccccggtcaggtccaccatctggtaacgcgggtccggcaaatccaggcacaggctcatggcccgttccaggcagactgtctccggtccacggcagataaaccgggcgctgcgggccagcacaggcagctcctcatagattgtgtagagaagcaccagctccatgccggccacagggtcctccaggtacagctccagggtacacgcctcctcatcctgttccgcataggtggctggcaggcccggcagctccggtttccccctttgtatggtgtgttttttgtatacaaagcagctgattctgcttccgttttctcttctgattccataagccgggtaccgcatatcccctgtgccaaaggccgggtattcctgcttgatgtgttccagtgaaaatgtcgtatcgtcctcgtagacacagggggccatatccctgtgtgcaaactccagcaggtggccgaagtcctccctgtggcgtatccgcttcccatagtaaagctgtcccatctgtccgttgggaagacaggccataatatagctgattttatcgttgtacagatgaaactgccttgacttttcttcatatagaatgcccatatagaatcctccagcaattattgcataaacacaatggcttcatagggtctgaggcagatgtcctcctcacacaaggcgacggcgtccccctgtgatatccccctccggtccggatagtttccaatgagtatggttccggcacccagctcccgtacagacagcccgctcttttgcgtccggtccgtaaaattgcacaggacagtcaggcgctcctcccccaaagacctttcatatgcaaatatggccccgctttcctccaatagcagccggtaggccccatacacaagaatatccatggtatgccttaattttatcagctgcttatagaagcacaggacggaatcactgcgcccggcctgctccttaacattgagccaggtatgattgggatttaccctgagccagggcgtgccatcggtaaatcccgcctgttccgtatcatcccactgcatgggcgtccttgcattgtcgcgccccgtatgattgatgtagcgcatcatctcctcatgggaaatacgtccgtttcccaccatctcacggtatacatgatggatttcaatatcctggaaatcctccaggctgctgccctgaaaattcgtcatgcccagctcctggccctgatagatatagggtgttcccttcatcatatagagacagactgccagcattttagcagacagctcccaaaacccggggctgtcattgccaaaacgggacactgccctgggataatcgtgattctcccagaacaggctgttccaggcctttccctccagctctgtctgccaccggctcagtactttcttcaggtccctgagacagaccgggttatcattccattttccaaagggtccgggattcagctccacgtgttcaaagtggaacatcatgttcagctcatgggactcgtatcccgcatactgcaccgcctccctggttcccacgcccacgccctctcccacggtcatccagtcaaaccgcgacaggacttcccggttcatctcctgcagatacgcatgaatcctggggccattggcgtaatagggaagaccgtccccatagggattcccctcttttaataccccgtcgggaaaccgctggtccttggacagcatggatattacatccattctgaagccgtcaatccccttgtttccccaccaggccatcatctcatatatctcctgccgtacccgcggattttcccagttcaggtcaggctgctttttagaataaatgtgaaggtaatacatgcccgtccttccgtcatattcccaggccggaccgcggaaacgggacgcccagttattaggcggtccctcgttcacaggctccttccatatatagtaatccctgtaaggattgtcacgggacctgcggctctccgcaaaccaggcatgttcgtccgatgtatggtttaccaccaggtccatcaccagcttcatccctctgtgatgtatttccgccagaaggcagtcaaagtcctccatggtgccgaacacatccataacagccttataatcactgatatcatagccattgtcatcccccggcgattgatacacgggagagagccatattacatcaattcccaggtccttaaggtaatccagacggctcctgatgccgttcaggtcgccaatcccgtccccattgctgtcctgaaagcttctgggataaatctggtacaccacgcattctttccaccatgccctttgttcttccatgcggttcctccactgtgttccggtgtgtgtatttccggcgccttacgcacccgcggggatgatacggtatgtcttgatttcataaggcagaatgaaatccttaaatgtatgcccgtctgtctcaaggagcttcagaggtctttccagcaaatcgcattcctccgcccggtatgcctcaaagccaagggttactgtcatgggcgtcctggtgttgcggttttcataaatgcggaggatatacccgtttccatcctctgcttttttcatcatttccacaaaacagcctggctggtccacggataccatgctccatgcttcccctgtgcctgcatagggcagcagggcggataccaggggcgagttcaggtcataggccatttccacggtcctggcctcctgccatcttcccttgtggggataaatggaataggtgaattcgtggatgcctatatctgcgttttcattgggataggtacctgatttaatcagggtcagtcccatttcaccgtccttgatgctgtggccgtatttacagtcattgatgaggctgagccccagtccgttttccgacaggtccgcccatttatgggcacagacctcaaatttggccgtatcccagctatggttgctggtggtctcccgctccacattgccgaactgtatctcataagaagccctgacggcgttaatccgggccgggaaatgaacccgcagcagcacatgatggtctctccagtccgcccgcgtcacaaagtcgattctgggcagattggggtagaacacgatatcctgctccacaagggagcctgcaaaccggtgggcgatggaaacaacggtcctgaccggcccccattcctttaacaccggggctgtcacgcagtcggcttcatagggcttcctctggtaaaacaggtccacatcccaattgtcccagttcatggggcggtcctcaaaggtcagaagctggtttcccaccctcccctcttttaacagctggcatcccgtttccttttcaatcagcgagacaagctccattttatcattaaattcagccctgtaccattcattttcaaagaatccgttccatggtccgggacattttccggcaggtccttccatactctgattcccgctatcttcttctgctcctgtgaggctgtacacggtatagccgcaggatgggattccctttgcgtggaatatgagcgtgtcctcccccacatactggaccggatacctgcgtcccaggcagtcgcaggcataggccgcatccgttctgtccacgccggacaccgttaccgtatcctcccgctcatagccctgcgtattgattacaaaaaccttgcgcgctgcgggattttccccgctgatatccttacccgctccgcagcccctgcttcccaggtcttttgccagatgaaggattgtatctgcgccggattccagtatgtccgtatactcccggtctgtctggtcatagacaggtccgatggcgcttcccggaataatatcgtggaactggttcagcaggataatatcccatcctctttttatgacatcaccgggatatgccaggcccttaagctctgccatgactcccagtgtctccagctgctcatacatctgctcgcttttcctgttatagcgtttgttctttcccatggaggtcagtgttcccctgtggtactcaaaataaagttccccatcccataccggcatacctggcttggacgcaatgccgcggtaaatccggtcaaaaaaggtccgttcactttcctggaccagcctggggatacccggaagaccgtactgaagacgctttgcctcctccagcatttccctggttggaccgcctccgccgtctccgaatccaaagagcattaatgtgtcctctgtcaaatccctgttctggaaccgtttaaaggtgcccagcgtcatattgggattgacaatgcccgtgtaagtggtagtgttcctggtatctgtaaatgacacatttaaccccagggtcttgtcaaagtcacaggcagtgggcatgaatacgaacacatggctgccgtcgattcccttccacatgaaggtgtcgttgggcagctggttaaactggttccaggcaatcttcgtggtgagaaaatagggaatgccgcattttttcagtatctgcggtatggcagcggaatagccaaatacatcaggcagccacaggcatctgctggggatgccgaattcctccataaagaactgctcgcccttaatgatttggcggaccagggattcccctgccggcaggttgcagtccgactccagccacatggccccgtcagtctcccagcgcccctcccttacccgctcccggatgcgttcatacagctccggttcctgttcctttacaaactggtacagaatgggctggctggacatgaatttatagtccgggtaccggtccatcagctccaatacggttgaaaagcttctcacggccttttccctggtctggtccacggtccacagccaggcaatatcaatatgggtgtggcccactgcgctcaccaccggagcgtgtaggtccacgtgttcgtaaaattcctttttcaggattgcttccattgcctccacggattggtagaaccggtcagaatacggttcccttaaatccagggcatctgccgcaggccccagctttaccagtatgcgtctgtaattttcctcatccggctttttcagaagccgggctgcctggaccggtacaagaaaatcatagtaagccttttccacggcgtcatccacccggaccagttccgtgcggataatcaggtcccccggcacgctgccgctgtaggccaaaatggctatctcataggactcccctgccctggcgccggggcttatcatgatttccctgtggtttacgtccacgccctggacgatgcttccgttcaggtaaaaaagcatctgggggttggttgcatcccactggccttcccttccggtggtgatgaggaattccacatgcgccccgtccaggtgcgtgggtattttaaccgttgtcctgtaccacctgtggctgtccaggctcccccagggttcttctatggcgcagtcctcccattcatcggtgcagcaccatggactgccgttttccttgccttccattcttttataatggctgaccggaattctcaccggcctgcgaagctggtttaagtcatctgccagacgctccatccgctccagttcaaataatatgctcatcctcttcctccttatccctgccggaatcatccatgcccttattttaccgcaggaaaagccggagccggcggacaaatttaatatctgtccgccggccccggcccgctcctgtgcaggacagcacgcttaacccttaaccgaacctgccgtaagcccttcaatcatatacttctgggcaaaggcaaagagacacattgtaggaaccagggacatgatggttcctgccgccatctcgccccatttaatatcgtacttcagaatcaggccgttaagccctaccggtatggtcttgaacttatccacgtcaatgaacatgactgccatgaagagttcattccatgaattgataaaggcaaatatgaaggttgctgctatgccgggcatgatgaccggcaccaccactttaaacagcgccttgaaataaccgcatccgtctatccaggcagcctcctccagggatttgggtacgctgtcaaagaaaccgcacaatgtcaccactgaaaagggtatcatcatattggtatagagcatggccaggctgcgcaggtcgttgagcatcttcacctttgccaggagctggtacagcggagccagcatgatgaacatgggtatcatctgcgtgaccaggaaaaacagcagaagcacattcttaaaccggaaatggaaccggctaatgacatagctggccagtatggcgatgaacaccgcacaggtggctgcaactgccgaggagaaaaaggagttcagcatataccgcccgaaattccccttccacagcatggccacatagttgaccgcagatgccgggttaggaagataccggaccggaaacgcatagatttctccctgggaaccctttaaggatgtgagaagcatccatacaaagggaaacatggtcagcacaaggaaacatgccagtattaaatatttcaacaggcttttgagccttttcttattcttcattgtcatgatatcatgcctcctcgtccgtatacttggtggcaaccagataaatggccgcaaatacaatgaggaacaggatacacagcacgcctaccgctgacgccaggccgtaatccagactctggaccagctgcatcatataggacgtgatgatgttggatgagcctgcaggcccgccctgggtcatggagtaaatcaaatccgggaaattaaatatccagattaccctcagcaggaccgtcaaaagcagcacggaacggatacagggcaccgtgatgttggtgaacttctggaacgggctggccccgtccacgtccgcagcttcatacaggtcttcggacacgcctcttaaggctgccgttatcataatggtgaaaaatggtatgccgtaccatatattggcgatgatacaggagtaaagggccgtgttcttgctggccagccatcccaccggctggctgattaaatgcattctcataagcaggtcattgatgacgcctgaggttccgttaaacatccagcgccacatgatgccgataataaaacccgaaacagcccaggggaagaaaatcaggccctggtaaaggctggaacccttaaatttctttttcagaagcaatgccatggcaaaaccaactgtaaactggacaaacagggagattcccacccatttgaccgtgttgagcatggtggagtaaaaggtattgctggtgttgtgggcaaacagcttgctgaaattttccagacccacccacttgatattcttgacattcatcaggttgtagctctggaacgccatcagggacccctttatcatcggatagtaggtaaatatcatgggaaacagtatggcaggaagaaccatgataaagatgaagcgggctctcctcatttttaattttgacgtttgtttcatgccattccctccttgccggctgcgcgttccgtttttcccggaccagcgcgcacagctcaatatccggaagtgccgggagcaggtcccccgctcccggcaccctccggtccttactgattgtgtttcatacgtttttcgtcaatccggccttaccacttctgaccctcatccttgtaagcctgggtccagaactcatccaaccactgcagcagctcatcatccgttatttcatcggtcaggtatttctggtacatggtatcaacctctgtcttataggtggcaaatgcctcatacatctggggatatgccgcatgacggtacacatccggttcttttgccatatccatgtacattgcaaaacgtccctcggagaagtaagtatccttctcagccgcattgttgtgaatcgggattgtggaataattttttgcaaagtatgtattgttctcggaattggataagtacagcaggaaatccgcggtctcatccggatgctcggtgaaggatgtcataccccagcctgcaaatccgttggggaatacagcctggcccgatggtcccttggggaacggaaccagcgcccactggtcatcctgcatatcggcggaacaggtggcgattacttccgggtcctgaatcagcatggctgtggttccgcccacaaagccctgcaccatctcagagaatccccatgcaatagagtcggtcggacaggtattcttaaacaggtctttgtagaagtgcagcgcctcttttacctcaggcagggtgaaaatagttgcaccgtccccatcctttaagaagtaggccgcattggggtccgccaccttatccgtgccaatccagctccagtaaatggtatccgcatactgatagccgctggggccgccgcggaaggagtagccgaacctgctgttagacgggtccgtgatagccaggccggcatcgtagatgtcctgccatgtctccggctggtcaagtcccttctcctcaaaccagtccgcgcggtagaacaggcctctctgatagaatccgtaaggaatcaggtaagcgcctcccttgaggtaatggattacctcgtcggccgactcggtcagggtatccttctcatcccacccgtcaatgtatttctgaaggtcggcaatccattcattggtggcatactgggtcacggtggaatcacgcacctccacaatgtcagcgccgcttccgttcatgagcatctgggtgattttggcatctgcattctccaggggcggggaaatgatatcaatggtaatgtttgagtgctcagcctgatacttatccgcaatctccctcagaacagccgtcctctcaggacttgtaagggactccaccagggtgatggtgacagcttcaccggatgcagctttaccgccgccgtcatccttgccgcctgcgtccgctgacgtggcagctgccccgccgtccgctgcttttgtggcatccggagcagcactgccgcctccgcatcctgtcagcatcacagccgccaatgccattgctgctaattgtttcttcttcatctgttctcctcctttttactgcttgattttcactgcttcttgttgctgttcttccaagcttctatatcttagcaagagccgattccaaatctgaaatcaaggcatctgtaccttccagtccgcagtggatgcggataacgttctgtcctgctcccagtacccggcaggcggcttcatccagtctggcgtgaggcaggaacacaagactctcaaatcctccccatgacacgcctatcttaaatatcttaaggccctccgccagctttaccgcatcctctgtggttccgtcaatctcaaagctcataagcccggtattgcctgtctgctgccgcttcatcagctcatactggggatgggagggaagcccggggtaattcaccctgcgcaccttgggatgggcttccaggaattttgccacctccatggctgcggcctgatgggcggccagcctgacctccatggtccgcagtccccttatcatgagccacgcctccatgggacccacgattccgcccagaagctccctgttggcggtcagctttttcataagtccctcatcctttactgccagcatgcctccgatgatgtcactgtgtccgccaatgtacttggaggtagtatgcattacaatatccgcccccatatccaggggctgctggtaaatcggagtacagaacgtattatctatgtacaccagcgcctggtgttcccgtgcaatccgagacacagcccgtatgtcctgaagagaaaataccacggaagccggactctccagcacaatcaggtccgtggcgtccgtcacagcctcctcaaactcctccacccgttctcccgtcacataggtgatggtaatgtccaaatgctccctgcagtatttgctgagaaagtcctttaagggtccgtatgcattgtggaggcacactacatggctgcctgccttacaggccgtgaggaccgccgtagtggctgccgccatgccggatgcaaaagccagggcccctgtgccgtgctccagggcggctatcttgtcctccagtatgcgcaccgtgggattctgcacccgtccatagcaatatttgtgcttgtcggtccggtcaaagtcatagtaatcatcaagtgtctcaaatacattgagcgaattcatgaataccgggggaacgattgcattgtaatagtgctcatactcttccccgtaatgggccgtgattagctttgtactttttaggtactcctcctgatttgtcatatcattacctctctcctccctgattatttgtaaataatatacaatcctatatgctatatgctataatataggttggaataaatttataaaatattatcgttggttccgtatatctctatacacagcatccaaaagcttttcattgattgtctgtgcttttttcacattcttttcgcagatggcattataaagctcctcatggagaggaaggctttccaaaaacgggtcctccatgttcagcggaaattcccagaacttatccatgacaccgctgatggacagaatcagctgatacatgacctggttatgggacagacggtagatggtatagtggaacttcttatcctccgctgtctgctgctccccacggcggaactttgccatcagcacctttgttatggcgcccagctcctctaagtcctcctgggttgcggagtggataaccatgcggagtatctcccgctccaatattttacgcacctccaaggtatccaggagcagttccttttccttggcaaaatcaatcagtctcagaaggtcattaatctcctggctccccacatagattcccttgccgttctttgcctccagtacgttcctggcctccagtgtcttcatggcttccctgagggaggtcctgctgacccccatcatctctatcagtttttcctgtgaaggaagacggtcgccgggttttaagttgttttcctggatgtaattctgtatatatcggataatctctgattggagagatgtacgctgtattttattagtcattatgctcactctcatgatgtttttgtttaagtttgatagattaaccttaccacatataatattgattgtcaataatggattatatttgcttttattacgtaatataaatatacatattgcacaattattttatcctctgtccccgcaggccccggaagaactccgacatcagctccgagcactcctgctccagcaccccttccaccacctctgcctgatggttgaaccccggttcatggagcatgtccagcacagaccccgcacatcctgccttgggattcatgcaccccacagcgattctgggaatgcgggcctggacaatggctccggcgcacatgggacagggttccagcgtcacatacatggtgcagtcctccagacgccagtctcctatttttttacatgccttttttatggaaatgatttctgcgtgggacagcacactcttatccgcattacgccggttatatcctctggcaatgattttgtccccgcagacaattacgcagccaatgggcacatcccctatggcagctgcctttttagcctggcggagggcttccctcataaatccttcatcccgctgtctctgctttaaacgctgctcctctgctgcaagggctgcaaggcgctgtttttccattctcttctcgtaattcctgcgccgcgtttcctggcctttcaggcgggctgcttccgcctctgctgttttgctgcgggtttcccgggctgtttccatagtatcctctccgcggtcaatgggttctcttctcatcatctgattcctctttttttaaagctctatgtgtgttatactttttcattatatagaatatttgaaaatttgaaaagggacaggttaaggtgccatgaaaatatgcggacttcaaaagactacgctgctggactttccgggcagggtagctgcaactatatttacagggggatgtaatttccgatgtccgttctgccataacagcggacttctgggttcagatgcagaagaatatgaatcacaggaatacgttctggcgtttctggaaaaacgcagacgggtgctggaaggagtctgcatcaccggcggagagcctaccctgcagccggacctggaggatttcatacggaaggtgcggagcctgggactggctgtgaagctggataccaatggctacatgccccatatcttgaaagatttgtgcgccaaggaacttttggattgtgttgcaatggatatcaaggcagggcgggaccactatgaagaggtaacaggtatatccggccttttcatggaacggatagatgagagcattaaatttctgcagtcaggcagtattccctatgaattccggaccaccgttgtccgcggtcttcacacatctgatgatttcagacagattggaccgtggattaagggttgtcccgaatactacctgcagtgcttcacggaatccggggaggtactggtcccgggggtctattcagactttacaaaagatgaaatgacggcatttgctgatttggtacgcccctatgtggggcgggtttcccttaggggaattgattactagagctaatatggaatgtactggatttaaggtatactgacagattgatgccaggcatgttttcccaccccggcacagcctggctgcgccgggatggggaactgttttaatcctggttttctaaccgtacatccgtataccagtatccaaatcggccgtcctgtgacggctgttttcttgccagcacaaaatgcgggaaaccaaacatggacgccatgtatttttcattactgtagtaattgcccggcaccccaagtatgtatctggtccgcccttttgtctcatcgccgatgcgggctaatatcagataacggtaattatagtatccgtgcagcagaaaactgttattgccgtaattccagttctcccgcggaagcagtcctatatcctggggcttgattgtcagaatctcacacctgttggagctgtcaaatgcctgtattttgggataccgcttgcggaacccatcccaaagtctgccgggaaagtccgattgctgctcttcctgctccagccgttccaactcccggggatttcccagtatcagagtttcctctcccgcatcaaccacaggcaccttttcttccgccggtcccattgcagtactgctgtcagctgcctccggtccggcctcccctataaatggctgacttccctgagatggctgctggctgaccggacgccggtttggcattgggcgttggtttggtgcgggctgctggcctcccattggctgctgcccccccattggctgctggcctcctactggcggctgccctcctactggcggctggcctcccatcggctgccgcttcatggaatactgctctggcatccgctcccggtccgattgtcccccggagacacctgtattcattgttcctgttggcatgtgtctgcgcggcatcccaggtctggtcatgatatttggccggggaaccgttctgttcaccggtgtattatcaggctgcagcggtatgcctgtatcaggaaccatatcatccggcctaggcgcctccatattcagcgaatcttggggtgtctggagcccgcggggcatgaatccgttctcctgagaaagctgtttcctgatggatgtcacattcttttcattccagctgcgctgggtattctgctgccgctctgcagaattccagttgttattccaggtcccgcgtccctgttcctgctctctctccctgtttgcaggcgttgcaccatcagcctggtttaagtcttccacaggtgcggttccggccgcgtctttattccctggcgctgccgccctctctgactggcactctaagggggaatccgatgtatcttctgattcctgtgtttcctccaatccatccggcgctttgtcctccagtgattccggctccatctccatactgtcttgtgtatcaggcagccgcaccggttccagctccaactcctccccggcctccggatacgctgaagcatccatctgatttacaacttccgctgtctccccattggtttccggtacgctgtcagcctgctcctcctgagtctccgcagtttcagctgtttctgcccccgctgtccccaatatcatttcttcctgagatatttctgcctcctgtaccgactccacagattcccggccttcctgcacgtttgcggaatcatcctttatcccgctgtcaggcgctggttttaaagaggattcctgaatcccgttctgtttaccggcaacgcgcatctcccgcgcccctgccggtgaactgctgaggacagggctgttcccgccttcttctgccttttcccctgcccgcagctcctgattcagttcttccacttttctatgtatctgcgcctctgcgtctcccactttactggaggtcacatccgccagctctacctcggccgcatgggccaccgcatcctcccagatggttgtgtaggcccgccatgaatcaccctgttcatgtatggtcaggccatagcactggtccatgcagcagccggaatcagctgcattttctacattcaccacagcgcggaattcgcccccgccgctgcgtataaaaatacttcccaggaaaatctcctttcccggagccagcagataaacccccaggtcgctgcttccaacgtaaaccttttttacatttacgctgagcttgcattgtccattccgggattccagcttggcaaacccaatattctttccttttacctcgccttcataggcgtagatataagatatcaatctccgataattggtcatactttcactcctcgcacccataatctgcagctgccctgaacacggcctatctgcttttataaatattttatgcatttaccccttgaaagtatgttaggaaaatgttatcctatatttaaagattaataaaaattttttccaaaacagtggcccactggaaatccggggcagcgcaactactaataatgtatggaaaggtggcaattattatgaaaatctacaaagcaaaagattacgatgaattaagccgcagggcagccagcatcatcgcttcccaggtactgatgaagcctgactgtgttcttggcctggcaaccggttcaacccctatcggcacctacaagcagctgattgagtggtacaacaaaggcgatttggatttctccagtgtaaagagcgtgaacctggatgaatacagagggcttaccagggagaatgaccagagctactactacttcatgtacaacaacctgttcaaacacatcaacatcagcatggacaaaaccaatgttcccgacggcacccagcctgacagcgaaaaggaatgctcccgctatgaggacgtgattaagaatttaggcggcattgacctgcagcttctgggcctgggacacaacggccatatcggattcaacgagccggacgaagagtttgccaagaccacgcactgcgtggacctgacccagagcaccatcgaagccaataagcgtttctttgcttccattgatgatgttccgaagcaggcttataccatgggtatcggaaccattatgaaggctaagaaaatcctgctggttgtcagcggcgctgataaggctcagattctccacgatgtactccgcggccctgtaacccctcatgttcctgcatccgtactgcagcttcacaacgatgtgattgtggttgcagacgaggctgccatggctaaattatagcatccggtacgcttactaccggcatacttaatgccagcatacttactgccggcatacctaataatcatatttaacatcaagcatattaattccaaaaaaccatgcctctctccccgaccggaaagaggcatggttttttaacttcacattctagcttcacattctgtatcagcgctatttaagccggctgttccttgccctgctgttcctgcgccagttttttccgggatagcttcatgcatcccagggtggctaccagggtaaaggccatggatatcacgcaggcaggccagatgatgctgtagtttttcgtaatatcatagagaagggataccagaagcgtacccaccacgccgccgaaccggttcactgaaactaccattccatagattggaccgtaatccctgtttccgaatatcttactggtaagaagggttggcattatggaggtgatgccggatgcaagcccgtaagccacaatcatcatataaaatgccacctggttctttgcaaatataaatcccacaaatgccaggattcccacgccgcacacataaaccgtggcagccttctctccaaaccggtcagtcacatgtcctaaaatcagctttccgaagattcccactgccatgtaaccggacacaacctttgcagccacagctgagccgtatccgatatcggtcaggtaaaccggcagctgcagggctgctcctgttgcaaaggtcatacagaagatggccagcagaaatacatagaggataggggaacgtctggcctcggccgctgtcatgcctgtaacctgcgcctcctccttctgggcgccctgcgtcctgttactggtgtttgctccatttgcagctacattttcagctccgtaaggccgcaggcccacatccttaggcgtggaccggaccacctggtaggtgacaggcactacgatgaccagcatgattaatcccatggcgcggtctgaaaagcgccagccatatgtactaataagccgttccaccacagggctgaaaataactccgccgatgctggttccgattgcagccacactgatggcaaacccccgcttctccttaaaccagatggtaagcagaatggatatgggcagaagtgtgcttccggtaaagaatacacccttgataaaagccaataccaggattccccatatattgggcatcagtgaacggcctatggtacagagagccgtaacagccacacagccgggaagcagttttctggccccgtgcttcttatacaatttcccccagtaaggcgctgtcagcacagctcccaccgtaatgcatacactctgcagggacagcagtgaccttggaacctgcaggtcattgtacatcggtacaatgtacagggaactaatctgcataaccagcgcctgtacaattacattgattaaaatacatacgcccagaatataccacgcataatggacctttttcttctcattacccataatctcttctcctttaccatgaaaacctgacatatatttcccaattgtttacgcatgttcgcgcagccactgctctgccacctgggcatatgcagctgcccccaggggcaggcatgcctcattgaatcttaccttcggatgatgctggccatattccacatccttgccaactgccgctcccaggacaatgaaggaggacggtaccttatctgcaatgaatgcaaaatcttcagagccggggaaggatttacgcagcagtttcagctgcttttcctggaaaatgccgcccagggcattgtatgcagacagtgcaacctcctggtccgccaccagaggtatggcgtagttctcatccagaatcacttctgcctgtgccctgaatgccctggccactgactctgacatctctttcattctctctatgactgtttcccgtatttccttggaataagtacggatggttcccttcatctccacctcattgggaatcacattgaaggtagagcctccatggatggagccaatggtcaggacgcctacctcccctgccttgatttccctggcctgcagttcctggagcgcgatgtggatatgggcggctgcattgatggggtccactcccttattcggggtagagccatgggttccgtgaccctttacccgtatggtaaacaagtcagaagacgcacaggccggtccctggaatatcataaatgctcctgctggtaccacggaattcacatggatgcagagtgccgcgtccaccttgggattctccaggatacctgcttccagcatgttccgggctccctgcatatcttcctccccgggctgaaacaaaagctttacggtcccctccagggcatcctcgttctccttcagcatcctggctgctcccagcagcatggaagtatgcaggtcgtggccgcagcaatgggctatgccgggattcccggatgcgaattccagaccgctttcttcctgcatgcgaagggcatccatgtccgcccgcagcagaaacaccttgccaccgtcttctccggccccctttcccacagttgcagtgaccccattctgaccaatgtccctgggggagtatcccatttcctccagtttcattttaacatatgccgcggtcttttccacgtccataccggcctccggattatgatggatatgccttctgttttccgtgatttcaggtatcagttcctttgccctctccaaataattcactgtatcaccctcctgtacattttttatactatttaatatttattatatattttatttattaaatgtcaatatttttatttaataaatagtaaaaaatttcttgaattatttcctcttcattgttataatttgtttaaagggggattttatcttatgaattacagacttgcacttatatccacagaagaacattgcagttatatccggggaatcctggatggaatggcgtctgactgcgatgttgaatatatatattaccattcattcagggaacttcctgacctgtaccggcggattgaacctgactacgacgctttctgcataacaggggcctttgccagggaaaccattattaagtcccggacagaccagcagaagccggtatttaccatttccgagaaatccacggaaatctaccgggaactgctgaccctgattaatgagaaccgggatacggacctgagccgcgtcatgtttgactactccttctgcattcccaatatgtactttaaatcagccaaccgttatctggaaaaggaaatccagcatgaaaagatgcatgtctccatattaaagaacatgaccctggacgagctgctggatacagacaacaaaatcatcgccaatgcaacagctgcctggaagcagggacagttcgacctggtgctgtgccgtttcagcaccgcctatcccagacttaaggaggcggggattccctgtaagttcatctatcctgccgctgataatgtgacggacaccatcctgagaatcgtggacagtctggatatggaacagcttaataacaacctgcccggtattatctatctttcatcccctgacattaacagcaactccgccgatgaaataacgcctgaaagcgtgaaccttcaaaagtgtctcctggattttaaccgggaacataccaccggttttctgttaaagaaaacactgcagggatttgagatttataccacgcagcaggtgcttgaacggattaccgaacattttacagtctgccagctgcgcaggtatattgacagctgccttggcatgaatgtccatatcggttatggaatcggcgtcaatgtaatgctggcccgttcccatgccattgatgcctgcagcatgtcggcaaaaagcggtaaaagccatgtggtcacaaaggacggcagttatatcggccccctgggagcacaggagacgcgggaggaaggggaccctgtttcccagaaagtcctgcagattgccaaatccaccggcctttccatatccacgctgcaaagaatcagctctgccctggagctgattggctccagggaaatcaccacccaggagctggccagcaccctgcaggtcacggtggccaacacaaaccgcttcctcaacgccctgcagcagaacggctttgcgcagattataggtgaaaaaaagtccctgatgaagggacgtcccagccggatttaccgcctggagctgtaggaaaattaaaatccggcaatgcgcgccggaccgaaacaaaccggaaaacagacaaaggcggctgccctgcagtggaatctccactcacagggcagccgccttcctgcttatttattcaacagactcatagtctgcattataggtgagataatcatcatccccctgcttaatgtcatcgccttcatagttagcgccgttcaccttaagcttaagcttggacagctcaaagttttccgtgaaggtattgccaatctcagtgaggaacatcttgtcggagcatccttctgcgctgtcggcctgatttaaatccagggttccgactgcattttcctccttgccctcaatgtcaaagctgagaacgtttgtgccgtcagtcagcacgccgtattcaatcagcttgtctaccagaagctgcgcatccaatccctctgtatcaagggaatccatatcctgcaccaggcttccgccgccgccgtgatatacggaaataacagctaccggcatcacgttggggtccggaactttatcgctggccccgcctgtgcttggcggcaccatatcctcctgggatttagctgcagctgcagcagtggtttcttttttctgtttttcagtggtaggtgtacaggctgccagggatactgccatcaggacggtcataacaccaatcaaccattttttcataattgtaaagcctccttaaataatcctcttaaaagcttctgaaccaggtattgagctttgtcagcgcctttaccagggcttccagctcctcctcggtcagttcttttaccacgctgtctatcatctgttcatggaacttcttatgatgataataagccttaactcctttttctgaaagggatatgaatacgaccctgcggtcctcactgctgcggttgcggactacatagccctttttcaccaggctgttcacggatatggttaatgttcccaccgtgaccgacagttcccgggcaatggatgacatgttctttggcctgtctatgccgatagcgtctatgacatgcatatcattattggtaatatcacaaaattccgaggtgataattgccttctgctctatatcattgacatcgcggaacaggctaaccaaaacttcattcagcgtctcgtaagctcccacgtttctccctttcactttctgcttcaaaagcttcttactgattgtacagtattttaagtgttcgcacaaccccctaaatccttataaaattcttaaaaggttgtgatttttttgtttcatttacagttttatccaaatctacttcttaaatacaagacgcgaaaatgtctctccccgttcctcgaaattccggaagataccatagctggctgctgccggtgacagcacgcagcttgtgcccggccttgttatctgacgggcccgcttgaccccgtcctccagatgctctgccagtatgagtctggccctgttcctgaattcaggataatatttatgtatctcctggtatatcctcttgcccgtggcctccatcaggataatatggggcacactgcattccgacagatactcaatcagctccctgtagtcgattcccctgtccatgcctcctatgagcactgtgtccgtatccttcagggtcctcagagcctggatggtggtgtcgcaaatcgtggaaatggagtcatcataatatttcacgccctcccgctccccgatatactggagccggtggggaaggggctcatatgtcctgaggccccgggcaaatacctggtcgtccattcccagtatactgcataccccgtaagccacgcctatatcaaaataattgtgctgtcccagcagccggatttcatctgtgggaatccggaacgcccttccctgataatggacccaggtaccgtcctgcttctgagtcacatccagctccccgccgctgccgtccataccagcccttaccagcctggagggacaggccccttcctccggcaggcattgtacgttgcagattaagatatcatccgggcgctggttcttaaaaatatggcgcttggcctccacatacttttccatggtgccgtaatggtccagatgttcctcatggatgttcaccagaatccctatatggggggaaacagtcatatactccagctggtggcaggacagttcaaacacaatccgtgtgtccggcttcacttcctccatatggtccagggcaggtatgcctatattgcccaccagcagggcatccattcccgcctgttttagcaggtgatacagaagggttgtgaccgtactcttgcccttggttcccgtgataccaataatttggtcccggaagcaccggaaaaacacttctgtctgcgacaatatactgcacctgtattccttttcaggccgttccaggacaatacccggacttttaaacaccacatcgtaatcatccaggcatttctggtaatccggcccggtgtaccacagtgtaccgtcctcaggcacggaagcaggcgcctttacatccgcaatatccagggctttataggttcccagctgtctgaggacattccaggtggactgtccctccctgccatagcccagaagcaggacacgctttcccttaatccagggctctattttctcaatcacgtttgttctccttataagccatccacgcagtatttcctcaccagcagcgccaggtcatccggaaccaggtgattggcgtcatagtaagatgcgtactggtcccccctggcccggcaggtccggtactggtccgttgttttataataggaaagaagacgcggcaggggttctccggcttcctccagcctcctgattgtaagtacggctgctgtgtttatctcatcacggctgcccacgcactcaaagggcttttcttcctttatgccaaccagctggtccagggtatcttttaggtcccaatcctccagcatattccgcccaaagatatccataacctcctgcgccggaagaaaaggcgacagaatcaggtacacaaacaggcacttgggacaacggccgcaccaggaatctgtcttgctgccagcattgcagctgcggaaaataccgtggtactgcttctgcccggcaaaataccgggctatctggaattcactcaaagggcgcagcatactgaagtaatatgcgctccccttcagatatgtggtctgataataatggaaatcctcctcaaacttaaagctcttggaatactggtggtttaccgtggtgccctggaccgtgctctcattggcactggattcattggacagcgccaccatggaaagaccgtgcattctggctgctatgatgctggagaatgccaccagcgcggaaaacggcgtatggccgttcaggtatccctgccggttaagctccagcatgttggcatccagggtcctccttacgcttatgacatggtccgtatccagtccggccacctccgtggtgtggatggtcgcccctctgggattgatgatataggcgtacacggtctttcccgccagccgcataagttccagtgtcaccgcagaatcctttcccccgccaatggggaccaggacgccgcctgatacctgggaagcactgtgtacggcgctgacgccgggcgcctccccctctttatccgtttccgggccgccctctgcggacagtcctgtacgccggacgccgcaccggatatccataaaatgattggggtcagcttcctctatgccgttcacatagaaaaattcacccaatccattgaaatacaggtctttccaccagtctgtctggtcctggttcaggtatccggcctccactatcacctcgggagggcaggcgattttccagtagctcaccagctccaccattcccagggaaaatatcatatcctgcatgagcctgtcttccgaccatctgcagctgtccccatctgcctttgggaacacccacaccggcgcaaattcagacagccccatggtttcaaaccggtatgtaatccgcagctcactgtcattttcctctgtttcatatcctctgtaagcaaatcggggatactgctcccgcaggctcagatactgtttcattccttattcctcttctcttcacagcataaacccgctgtatgccagggtatgtccggaccgtccagccggagtgtccactcccgctgcccgcaggcatacccaaaaaccctgctgtaaacatatacagggcgcacatacaacggattccctttttctatggctattatagtcaataacccttgatattgcaatgtttttttgcactccggactgtttcatctcactgccccggccagtaccacgctggccgccactcctgccgctgtggcaatgagtcctccggccagtgtatatctggtcctggttatgcctacactgccaaaatacacgctcagacaatacagaactgtctcggtgctgctcataagtacagatgcaatgagtcccagtgaggagtctgtgccatactccttaaatatatccagcaccagaccggttgccgctgagttggataccaggcgcaccaggaccactggtacgatttgaggcggtatgtgcagcagggccgcaggcattgtaagcagttctcccagaaagtccagaaaaccggaggcccgcagtacacccactgacaccataagccccaccagggtgggcaggataccggccactgtcttcatgccgtccttggcaccatctataaaatcatccagcacaggacggccgcacaaaaggccgaatcccacaatataaaaaatcatcagagggaccattgcctctgacaggaaaatcaaaaatttcatgtgtcagttccgagtctgtttgtttattacatcttattccatacaggattgtttcatgacgggaaaaggatggctgcagcgcctctcccccatttgcaaaaactgccgtcctaaaaggaacggcagttctgctggtctgtttacgtgtgcacaccctcacgttcgtgcagccgcggcatatccataccgcactccgctatgattcccgctttctcccatgaagggcaatatataatccggtcaccagggaggaaagtattgcaataaggtagtaactgcggggaccttctcctgtctttggcaggggcgccagaggcacatcctcatccagaattgttacttttgccgggtcatccggccactgtgccatgggtacctgctccggctcaatattgatagtctctccagggcctccggaaggattatatcggctggagcctccgccggaaccgcctgagctgccgccggagccgccgcccgatggctctgtctcacctccggaaggttctgtttcgccgccggagggtgtttcatccggcacatgattgtcgaacaccacctctgtctgctgcccggctgcaatcatcaccacttccgtattgccgtccctgccgttgacacggacctggtagctgaaattctccccatcaataggggtgccctgtgcatccgccacttccgtcaccgtatattctcctgtaggaagcaaaatcaccaggctgttatccctgctgtccggaacatagtgaagcaggattacctgccggattccgtccaaggattcgccttctttattataatagcggtttccgtcccatatggtaaagtaaaatccttcctcaccctgcagggccacttcctctcctgtcacctgttttgttatcttcagggctccctgacttctgacattttcaaatataaagggaattcctgtattttctacaaccagtatctcatccggatattccctggcatcctcttcatccggtataatgaaataccttccttccgccttttcatagccctgaggtaccacggtttcttccaaatagtaaagctgacccttttcaagcctttctatcagggcgctgcaggacctgccctgctcatcttttaccggtttataggtaccagccggttccatattactatcgcccacttcaccggccttatacagcgtaaattcagcgccgtccagagggcgtcctgactggtccaccttataaatcctgaccgaaaaatcccctcctccggttgcccatggctttacgatttttactgcttcctccactgtatcctcaacagattcctggctgctgtagtagagctttgctgtgtttttggtgctgatggttgaacccacagccccattgagcatgaccttgtagacaattctgattggcgtctcgtccggcaggttggatatctcaaaactcctatcccccacactgataaccgcttcccggattgcctccgacgtattggcattgctcacctggaagctgtccggaagataaatcatcttgtcatttcccagggtatccttcaccgccagggtgccggcgcttatatctgctcccggcttattcaccaggatggtatatacggcagaaggagcagtggaaccgctgtattccattcccttttccaaaaaacccttgtcaatgccagtgctggccgaaacctgataaagaggcgttccgtcaatgaacatctgggctttatttacaaactcctttacggacgggtcggttattttggtggtgacatccagattgacatggtttcccaatttataaccgctaaagtttttttcaacctggttgagatgaatggtcactatctggctgccgtcagacattctgactgtataatctcctgcctcctggctgagtatatatttcatatttttaaacttaatgctttccaggaccattccctttggaattgtctcctcaatgtttacttcttcgaatttacccaaatcatggggggcgtttcctgagccgtagcctttattaatattcagggtccatacaacctcacccttattggcatctgtcttggacacgctttttgacagatagtcgtcaacatagtatggctgtgaggcccatctggtccaggtggaatcttgaattgtcagctcagccgtattcttaaaacgaagattgtctgccccattcctgctgaagccggcaaatgcctcctttgccacatagctgttatatgcaatggtgacaggtccctttaccgcttcattaaatttcacggtaaatccgcggtttcctaaattcctgtcaaaggccaggtcataaattccctggtccggtcctatggcatttccatttccatctgtcagtgcaaagccgtccttaaactgtttcaaactgccgaatgtgtgcttatccagatacgttcccatctccccggcattccatctgatgactgtcagcacatccctgtatacggcatccccgggtattactgctgtgtctgaatctgtcacgccgtttgaatacggcgtaaggattgattcccagcggatggtgccaaactcatcgccccatccaatgacacccgccctgttctgggttaccggttcctggctgttttccttcatgtcactgcttaagttcttctttgaaagagtataggtattatagagaaaacctacctgggtacctcctcccacacccgggaaaccgcttccctcaggggcaatcatctgaatttcattgttcagattgctgcccttgggctcattgaccgttgtataatacttgaagtcatagaagtaattacctggagccggtatcttccactcccatgttttagccttttgggattcctcctccttatccgtatcaatggtccaggtatccattacctgaccgccgtcaccccttttatcatatgcagttattgttacctggcctaaatactcctgaccttcctggtccttgtggttgaggtccagcgtgtctttcaccgtccaaccggtaagattgattaaatcagggttcacataaacgtggtattcgatgaaaaccggtattacttccccttctccgtctatcttctcgttataatgtgttatgccgctttttgtgacaatggatgcagagtggctgaaggatgagtctgcgcttgcggaggcgccttggctgcttgtgacagtcaccttgttattgaaactgagattcagggatgcgcttacctttttgccttcatcctcggtcttgccggatttcccccatgccccgggttcaatgttcatccagtagctgagcactgccttttcaccgggtttcatactggcgggagcgccgctgcggtccagcagcttaataagcttcgatgttccgtttcctccatccggctctgcgaactcagccccggctatgctgctgccttcggatacagaatccaccgcaataccggcctcagaatcaaatgatattacatcctttttattgtcattgaatttatccaaaatccggatatctgtcaaatccccagtgttatcctttcctgcctcaattgccacatggaagcgcactgcttcgggaatccccatttcagagtaacgtacatccccgtctttttctgtatcggtatcagcccatttgtcattgttatgtgtcttcttcacatttacagaatgcttttccacaacaggcaccgtttcaaataccagcgtcttatcgatgtccccgcaatgaatgactatctccgttttatctttgttctcaccgctaaaatctatgcttccgcttactccggcggttcctttaaatctctgccctacctgcgatttggtaatgcttatattgattgcgccgtctttctttataccggcccttccgattgcactgcccgatgtgtccagcacatcaaaacttaccgcatcatacagtatattggcaggaaaccggtaggtaaagctgtccccggcctttaccagataatccgcaagactggtatccccgctgttttccatggcataggaaatttcaaaccatgttttgatatccctgggaaggggtttcccatccttaagagtaatccgtgtgattccatcgtccccggttgtttctgttacttccagttcctgattgttcttgtcacacacagtaagcttcggatatccggcgtccatcagtccctggtcctgaatatcgaacacccggccggcagcctcatccccgctcagaaatgccggagaaaaggttgtgaagtggctggtggcacagcttaatgtattaatcacctgtccatccggaatctcctgatggctgtcttccatgacctccaccgtgtcatcctgttccttaacccataagacctgggccgcctctgcttcccggctcagtgtttccataaggctgcccgagaaacttacctccacctgaccgttccggttccattccccgctgtcaagcttttcattgccaagccaaaggttgatatcgtatgcaggcgctgcaatgactacctgtccctgctccgcgcccttctctttaatgacatcctccacctggtccgttactatttcagccgtggccgatgttccccagggaagtaccccctgttcagcggatatggtgatgtccattccgtcgctcatgtggaatgtccttgaaaattcaggggatattccctgctcattcagggtgatttctattttctggtcctcttcaatgtcctccaggacataccacgcaatgccaccttctatctgttcagcttctaaagcattaccattagcaaatgccgattccaccatgtatccgtcttctgttttcacaccaaaggttatgctctcaccctctgctgcgctgcggggtcctttttggatatatccttcagatttaggtgtaatctcatatgttatctgataaccttccacatcctccagcacctttagtttacccaaagtggtgatatatgccttagccgtgctgcatccgcccattcccaccaaatcgccatacccgatagaaggagttgtgtgctcctggttttccggctcagagggagttgcttttgattcctccggctcggaaggggttgccggcagtgcgtccgggacggttgtattgggcgtggtcgtgtccgatgcggttgtctccggcgcggttgttcccgatgcggttgtctccggcgtggctgtatccgataccgttgtctccggcgtggttgttcctgttacggttgtgtccggtgtggctgttcccgatgcggttgtctccggcgcggttgttcccgatgcggttgtctccggtgcggttgttcccgatgccgttacctccggcgcggttgttgccgatgcggttgtctccggcgcagttgtgtccggcacagttgcctccggtacgtttgtttccggcccagatgttttcgactcagatatatctgttccgtccgtctctggcttagatgattctgttttatccgctgttgtccgtttatcttcgaacattctctcctgaacagtgctgttcagggttgcggtattctgaaccccgtcatcctgtttcacagctacccttggtacttcatgggaggaacgtccggccacaggctctgcagtctctgtatctgcgtcctgggcgtcctgggcgtcctgggcttcctctgcggtatccccgtcatccttttttcctgccccggcagcatcatccgcttcggttaccctgcccgattctgcgctatctgcagattcctctaccccgtccgcttctgcgctatcttcagtttcctctgccctgcctgcttctgcggcacctgcagtttcctctgccctgcctgcttccgtagcatctcctgtcttcccttccccgtcttctgaggcatctgtttcttctatccagcctccatccgctgcatctgtttctgccatcccgcctgctgcggtatcttctgcttcctctgccttccctgcctgttccgtcttccgtccgctgtcagatggatttgcaggtgcgccaaaatcaatccggttatccccaaatgcatcctcgtagcccttaacattcacacgcctggttctcttttcaccgccctctgacaaatcaatgaccgttgaaaatcccattgtgctatccccgttattgacatagagaattacaatctcctcctgaccggtaagcgtatatgcatcatccacatcctccggcagacggatgaacgtgcggatttccgcttccatacccggaccgtcaaactccggataaaattcatacaagggctcctggttctcaaaaaatatctgataatatttttccagcttgccatccgtaaaatttaaatcagcttccgttaccggcgatgccccatttcctatcatctcttctatggcatccacaaagtctgaccccttaatgataaagtccacacgttcaccggcggcagcataagcaatatttgaactgtttcccacattcgcaaaagccagtgctgctgacaggcaaaatgcagtcaatctcttcccaatatttttcatattgacctcccttataatttacacatgagaatatacaccttttgggttacatttgagttacatttgttattttttcgtaaattcccattttttcttgccgaaggccctatatctgtatcattctcaccatgcgcatcagctccagcgcactcctgaagctgaccacctccccctttgtaactctcccccgcacacttccctgcatgctggaattctgtctgtattttatataaaccaccagcacttccctggccttcagcgcatgctgaaacggaatatggtctatgctgtaaaccaggttatctttgctggcctggggatgatgggcactggcttccctgtactgtttttccatctccctgtttaaaaacctgtaatccgtggtgggatgaggggctcccacccagttgcacatctcatccagcttcaatatcatgtctccggccccgttgtacggcaccggttccctgagataacaattgcagatttctccatatggttccccttcttttgtgccctggatacataccatcatcgtgcttgccctgtctgatacaattaattcctcaatacgccttatggcctcttcatcctgtaccaatctgccgttcatttttatctcctctttcattcatggtttttgatttcctgcttacaacagaatccctcttttgttgtaaaacattatttttactgtcccccctcacctatcagaaaaaacctttacggtaaatcagtacaaattaaaatacacaaaaaccaggccggttagataggattttaaccagcctggtttttgtgcagcagagcccaaataaaccaacagctttttacattcatatggcatacacggaaaatatgtagtataatactttcaaacagatgcctgctgtttacaacaaaagagggattctgttgtatctgtctatcagcagattcattttctccagctgtctgaggtgtttctccccgctttccattgtatagattcttgtagtattgacactgctgtgccccagtatatctgccagccttaccaaatccttttcctgactgtaatatacccttgcaaacagatgcctgagattatggggaaataccttgtccgggttaactcctgccttttggctgatttgtttcatttcccgccatatattgctccggtccatgggctttccgctccgcgtgacaaatatcattccggatacaatattcatttttcttgcatatgccttaagaagcctgcacaacccatcggtcaggaatacggtccgtacctttcccttgcagtccacctctgcaatctgcctgtccactgcatttaccgtaatgtaattcagctccgatatacgtattccggtggaacacacggtctggagcagcaggcacagcctctcgtttccttcgctgccggcaaccttcaccagacgtatatactcctccctggaaagctccctctgcccggaacagaataccctctgttttacctttatgaaccgtaccgcacagtcctcccagccaagccatctcaggaatccattgagggcagcaagggcgctgtttgcagtaacgggagaaaaccgttccctcagtccttccttccacaagattaccatatccttgctaaccggtcttccattcatatatgacctgaacagattcagataataataatatttttttatggtgccgctgctcatctcgttctgatgcatctggcggcaataatccttcatcatactgtctgaaattactctcttagccatgtccgttcctccttgagctgtctttggtctgtccctcatcgggtaggtttcccattccattgcggtttattctgccttaatgattaggttttacaggtaaaataaacaggcacccgaaacccaaacagttccggatgcccattcataagcttaccatttcataattacaccctgtaaagctgcgcctaacagcgtcctccagcttctacaggccaagacctttgctcacattcaccacaaaatcctgcacattggtcacaatgctcttggcagacaggcttcccctgtcccccagcttgttcacagcaaattcagacacatccacactgtaaaaatacacctggcggatggtgccgtccggcataacgcggaaagacggcgtcatgttgcctgttgcaatggagtgaagcgtggtggccatgcagataactgtggtagcctttttcacacagtccctcatggcatcctgcccttcatatacattggcatatacctcaggcagcggaccgtcatcacgaatggagcccaccagcacaaacggcacatttttcttcacacagctgtatataatgccgttatcaattccctctttttcaacaaagtccggaatagagccgtggtattttacccggttgatggtatcgatgtggttgtaatgaccgtttggctgactgtactgggtatagatattctgccccaatgcagtgtttaagtaagcgccctccaggtcatgggtggccagtgcatttcccgctaatagagcatccacatatccgttcatcaccagttttgaaaaggcttccctggaatcggagtcaaaggcgcaggcaggccccataacccacaccacatacccgtgctccttctcatggcgaagcagttcatagatgttgtcgtaatccttggaaaatgcagtttccctggaacgtctctggcggaaggcaaatgcctcgtcatggcctccctctccctcgtcaaagccattgggatatacgaagattccgtcctcacagttctcagtccgccctgtaaagaccaggtccccctgttttaagttcctgaactccctgacataaaccgctccattctcatacactgccacgcagtccatacggctctcttctgccagcagccactgtcccttaaccttaaaatactccggaaatatagtggtggcatggtaattctccggtgcaaccttatcctttggcgccggagccagcacagcgtccggcgcatccgtaaattggctctggctgaaatcaggcgccttatattttaccagttcaaatgacattgagttatccccctatacaattataatactatatgatttcattcttaagtttaagcatatcacgattcgcggcgccacgcaatgacgccaggccatgttttcaacggcctggcgttataatgttgtatatcgagtattactgcctaaggattcaccacattctgcggtgctccgctgagaaatgcatggagattttccaccgccaaatccatcagtctctgcctggattccttgggagcccatgctatatgcggggttataatgcagttgaccgcatccaaaagaggattatccatagaaataggctccgcagacaccacatccactgctgctccagctacctttccactgttcagcgcatccctcaaatccgactccactatgagcggccctctggaattattaataatcattactccatccttcattttaccaatggtatccttattgataataccctctgtttccggaaacagaggacaatgaagggctatcacatcagatgaagcaaacacctgatccaaggaggcatatgtacacgtttcgcttaccagctgcggattctgatatgtatcatatgccagtaccttcattcccaaagcctgggctatgcgggccgttccctggccgatgcgtccaaatccgatgatacccatggtcttgccggccagttcaattaaaggatggttccaaaaacaccagtcctgattctttgtccaatcacccctttttacacagtccgaatgctcgcctatgtgatggcacagttcaagaagcagggctatggcatattgggaaacagcgtccgttccgtaggtgggaatattggtcacaatgattccggcttcctttgcagcctttacatctaccacattgtatcctgtggccaaaagaccaatgtacttaagccttgggcaggcatcaatgacctctctggaaacaggcgttttattggtcagtataatctcagcatctccaatgcgggcagcaatctgactgtggtccgtggtacggtcatacacagttaagtcccccatagcctcaaacccctcccagcttaaatccccgggattctctgtatatccatctaatattacaatcttcatatatattttcatcctttccttttacccagcgtacaatacagcgttaatcctccaccaatgcccatgcccggttaatcacacgcttggtgttcgccagaatgatatccccgtcttcattaccccatggttttacttccagagacagaacatagggcatcaaagactggaagaaaccttcctcctttaagacagtaaagaaatctctcaactgttccacatcattcgcactgttgggaaatccaaacctggggtgctggtcgccgtaggcctcacagccttttctgaccaccgcattcccaatatggaaatgagtaatatagggacgcagggtctgcaccacaaatctggacgtttcataagtagttggaaaatgtgataaatccaccatgagtccaaagttattatgggacatcctcatatctgctgcaaacctggccgcatagggtgccggtcccataagggctgatttatccatgtcaaaatcaaatacctccagttccaccatcattcccttttttgctgcatggctgcagacagacctggtggtttttaagagctgttcataggcaagattccgggttgcctcctcccatctgcctgccaggaacgcaatcccgccagcccccagatattcggcctcatccacggcctttataagtacctgctccgcctgttttcttccatcttcatctatattattggggttaagtccgggccccagcaggcatggctgtgcgccaaaacataccttaagatgggattgttccagaagatgctttacctttttcctggtctcttcatctggaatgctggtgatctcaactgccgagaaatattcatctgctgcaattgtctttatggaatccaacaggtcataggataccggcggatggctcatccactgaatggttcccacctgaaaatatttctgaattgaatctttcatgagcttctccttcaacttatctattaaaatacccgttctgttttatcacttgcttctgccggattacctccctggctcttgcagctatattccgggctccatacccatatttttccattagctggtcaaggtcaccggactctgcaaatgtctcggctcccaggattgacacgggtacagggcaggacgcagataccgcctctgctaccgcacttcccaaacctccccggattgaatgttcttccacggttagtatggcccctgtctttccggcacattcttctataagctctgcatcaatgggctcaaccgtatgcatgtcaacaactgtggcgcagattccctgctgttccaaaaggtccgcggcctccagtacacggtgaagcacggttccggtagagataatagtaacgtcgcaccctttcctgtgaacgattccctttccaatctcaaattccatattatcctcatataccaccgggtgaggagccctggacagacgaagatatgccggccccttgtagtctgccagtgccatgactgccttttttgtttccactgcatctgatacggatataactgtcatacctggaatggacctcatggcggctaaatccgtaatggcctgatggcttgccccgtcataggaatccgacagtccgcagtatgttccgcacagacgcacattcaggccgtcataggcaatcagggactggatagggtctaatgccctggatgtcataaaaacagcaaatgtattaacatagggaatgaatccctccagcgacagccctgccgccatattaaccatgttgagctcgctgatacccacattgaaataacggtccggatactcttttccaaagaggacggactttgtggacccccccacatctgcttccagcgcaaccaccttccggtttagcccgcccagtgcttttaatgcctgtccataggcatcccggatagctatcttatcactcatgtgccctgcctcctaactccagttttgcctgcctgtattcctcatcattgatgggctttccatgccagatattctttccttccatgaaggagactgcctttccttttacagtacggcagataatgattgaaggcctgtcctttactgactttgcctctgataccgcatctgtaatggccgccacatcgtggccgctgcagctgattacattccatccaaatgcattccatttggcggctatgtctcccatgggcatgatttcttccagtgtaccgtccagctgcacaccattataatccaaaatagctatgcagttggcagtcttaaatttcgagccagccatggccgcctcccacacagctccctcctgtgtctcaccatcacccataaccacatatatatatgcgctgcttcctttcagccgttcccccagcgccatgccgataccggcacccaggcccaggcccaacgggcctgtggatagttcaatccccggtgtcttatgtacgcaggggtggccctggagatgggaacccagctgacgcagggtcctcaggtcctctctcggaaaataccccatatctgccagaatcagatatagcataggtgccgcatgccctttacttagtatgagccggtccctgccctccatatttggattcccggaatccgtgttcatgatttcatagtacagagcggccagaatctccgtgcaggacagagaaccaccgggatggcctgtctgaatgctgtgcagcaggtcaatgaggccgccgcgcagttgaagacatttattatctaattccaactttctttcttccgtcatatgctatctcctctatcaataatcctcaccaatggatttaatccgtaaaagcagctgtcatatctttaacccattgcgctacaagagcctccccatctacatcatatgcaaagaaattgttgggctcacgtccccataatcccatataatcaataatggtctctccatcgcaaagtccctgggtttcaatgtcaattgtagtgtgcatggtacggaaccactgcggattaattaaataacctgttgtggttaaatcattaaggccaatctctcccttttttctattggcctgattttctgcctttatttctcccactttatttccatttttatcataaataggttttgccgccttattgatacggaaactcagcagcctggtaagaaaatccgttactccggttccggctttggaaatagtctccaaatcctccaccctctgggtgaccatatcacatacatccaggcccaactgcaccacgggtattttagagttgtacaccaccttagccgcctccgggtccaccataacattatagctggccctaggagcctgattgccggataccttaaaggttccccccataaaaatcacttctttcacatgattttcaaagtcagggtccagtaaaacagctaacgcgatattggtcatggggcctaaaacaagaattgtaattggctcaactgcttcctttgcaatgcgtactaattcaaccggagcatatccctttcccacctttgtacagggcatggggaaccccaaatctccaaacccatctttaccatgcatccaggatgcttcaatggaagggcgcaccaaggggcggtatgctcctttatacacaggaatatcctgccgtccgcatacttcaagtgtgcgcagtgcattgattgcgcaccagtctactcccacattgccgttggtaacagtaatcgccttaacatcaaactttccgcttgcaaggacccataaaatggaggccgcatcatcatctcccgggtccgtatcaataataaccggtattttatctgtattttccatacatctctccttagttttaataatccggtaaatcaatggcagttaactccccaacattaattccggtaaaaatgttacgattgcaggacaatatgttataaggaacagcgttagcaccaacagtgcaaacatcggcatggctttcctggcaatccgcataacaggaatcttcgtcactgtatttgccatgaacaatgataagcctaaaggcggggtcagaagtcccagtgtcgtgttaagcgccataatgacacccagatggaccgggtccactcctaccgccgtaagtgttggaagtatcatgggggcagtaattaaaattgatgaaataccttccataaaacaaccgattatcaacagcgcaatattaaccagcaacagaagcagatatttgttgtccgtaaggccaattaatatctcggaaatcattttgggtacattttcaaacgtaatcatatatgaaaagcaggatgccattgcaaaaattgcagaacaacttcccaatgtttttccggtatttacaagaatagccggcatatccttccacttcagttccttatagacaaacattcctaacaaaaatgagacgacacaggccacgcctgctgcttctgtgggagtgaaatatccggtataaatcccgcctaatactacaatgggaatcgacagggctccgaacccttccgggagggcttttataatttccttgatggaataggcctcgctggtggggaaattatattttttagcataccagcatacctgtagcataagtacaattcccataagtatacccggaaccagtcctgccataagcagcgctcctacgcttgtgccagataccaccccgtacataatcagaggcaggctcggaggaataatgggacctatggaagcagatgcacaggtcagggcagtggcatactccttgtcatatccctgttccgtcatcatctctatttccattggccctaatgcagccacatctgcaacagcagagcctgttaccccggcaaacatcatggaggctacaatatttatatgtgccatacctcctttgaatcttcccacacacacctttgcaaagtggataattctacccaggcttccccccttatccataatatttcctgcaagtatgaacagagggattgccacctgtacaaatgtattcattcctgaaaattggcgctgcagaatggtccaggcaggaaggtcatgggtagcaaaataaaacagacaggttcctcctaaaacatagtaaataggaattcccactatcattaaaactgcaaatattataaatacgattcccataagctatttcctttctgccgcctttaattcgctaatcttattgactatattgacaataccaaaataaattgcgaatgcatatcctatcataggtcctaagtaaacataaaacagcggaatccgcagttgggctgataaagtacccgcattatacgcataggcaatatagtcttttcctgaccacaatacaactcccataaaaagacagccgaaaataatccagaaaatactcatacagcctttaaccttttcagaaaaaccgtggatgaacgcatctacgttggacagcattccatgtctgctggccacagcaaacccaaaaaatgtagcccatatacagcaatacgtactgacctcgtccagccataccaccggtatattaatattacgtcccagtacacctataaaaacggacagtcccaatattcccacaaatattcctataaatatattcaggattttttcaaataccgctgctatctggtttaagctttttataatgcccttctgttccttcatttgttcctcctatccgccagccggatgcagtgcatccggctcttgcccaggtgctactttaattccattatcttttttgcaatatcctgtacccatggctccatctgacttaaatacttttcccgcacaggggcaatggtttgatgaatggcatctacatcaatatcaatcatttccacgccctgtgtctttaaatattcaatatcatctttattaatctgatttgccactgtatttaactctgtcagacaatctgccatgcattcatccaaaacagccttatactcatccggtaatttctcatacaaaggctttgaaatcactaaatacataggagaggcgaaaatcttgggttcggccatatattttacgtggtcataaaaattcatggtacgcacacttgtgggaacatggtccaacccgtccactactcccagctgcagaccgctgtacaactcagaccaggcggttgtggtggagttacatcccaatgcctggaaggtatcaaccagaaccggagaacccatgacgcggattttctgaccctgaaaatctgctacggtcctgattggttccttggtgaacagcatgcggaaataatcctggtaatagccaactgctataatattgttatctaatgcctgcttcttaagcggctccatgatttcatcatcgttcatagcctctttcagagcttcgtcactggcaaatatccccggcaggttaatcacttcaaaagacggcacaaagttagctagaagggtaacagcggcaaggtttccggcaatggttcccatctgcattccttcaattacttcctgttcagagccaagtgtacctgaatgatagatttcaattttaaactttccattggtcttgtcagccacctctttggccatattttcagcggcaatattcataaaattatccggcgactgggtatgggatattttccatgtgatttcagggaggtcctccgaagcctgacttcctgcttctgattgctgctcctgatttgtggtctgttcttttccggcagacgtgctattggaacttcccccgcatccggccattaacgatgaacctaacactaccgacataatgatactgactgctcttttcatcctcttcatttttccttctccttatatagttctcagcttttatcttttattgtactcttcgataaatggtttcaaatattgtacggatgcctgggccatcttatcgggattttctcccggaagtatctccaccgatacccacccatcataatctgccatcttcagagcgtcaaaaactccttcaaaatttatgtgtcccattcccggcgcataccggttggaatctgcaagatgaacataacgaatccatttgctgttcctcataaggctttttccgatatcatcatcctcaatgttcatatggaacacatccggctgtaatccgcaattttttttgcctacctgttccaggatagccgcaccttcatcaacactgttaataaagtttatctcatatctgttaaccggttccaaaatcatttccacattatactgccctgcaatgtcgcatatctcccgcattgtctctatgaaccgtttttctgtcatctgccgtgatgtgtcttttgaaatgaaccccctggcacgtccgatatttacctttcccccaaattcagaagccagcttaatcaaatcagcaaatacccctattgtctctctgcgtaccccgggattggggtgagtgaaatacattcctctctctgcaaatacctgtcctgtagaaatgcagcttatctccatcccatacatttccagccatcgccttaatttgtccccgttaatctcagatgcatccttaagtgccagttccacgccgtcatagccacattcagaagcttttcttatggattcctcaaaccccctccatacaacaaatgcgctttcctttgcctcacttcccgccactgtaaccgctattttcataccagcctcctatctgtttaaatcatggaatatatcttcctgtaatggaatgattggctgacacagatgttcctcagcttccccaatcagttccagggaaatagaatgccggccggcctcgtactcagtatccagccatgcatccagaatatccaatgcttccagctcacctatcaccttccccccaaggcacaaaacatttgaatcattatgggctcttgtcatcttcgccatataggtatcggtgcacaacgatgccctaacccctttaaaccggttggctaatatactcataccgattccggtcgaacatataagtattcctctgtccgtttccccccttgacactgcgccggcaatttttgctgcatagtacggataccttactatttcttcagtgccgcttcctatatctacatacgcaatctccctttttttcagatgctccatgattgattgttttaatttatatccgccatggtcatttccaatataaaccggtttctgcagcattataaataccacctttcaacatataaaattttttcttccccttccctatagcagcatccgcacacaccgggcgggggtgaatcgtttcattttgtacctaaaagataatcatcttaccattccaacactttccctgataataagatgattttctaatgtaatccgtttcgttgtatccatgccttcacttccgtttatgcatgcatgcagcattttcaaacattctgtccccatattatatttcggttgatggactgtggttaaggccggatttgacaggttgctcatttcaatatcatcatatccaataattgaaacatcctggggaatgcgataccccatggtctgcactcccttcattgcaccgattgccatcatatcattggctgcaaaaattgcagtgggagggtcaggcaggctcatcagctgtttcgccaaccggcatccgcttatccagctgtaatttccgctaacaacatattcaggcctgtagcgaagcttccgtgattccaggtaacgtttatatgcatccagcctgcactggctggaataggattccatcatgcctgtaatcatggcaatctgcttgtgcccgttctgtcccagaaaattcattgcacagatgacaccttgcacatcatctgcatttacaacatgaaactcatttctgatgtcaatactggcatcacctaataccagcgatgtcctctccttcacatcaagcagttcgccgtactccagacgcggctttaataagataatcccatcaacgcctttggaaagcaatgcttttatatatgccctttccttttccgtatccctgtcatcgttacatagaaatacggtcagtccttcccgtcttgctgcatcttcaacaccccttgccaattccggataatatggattggttatgctggggataatcaagccaatattcttagttgtcttggtcctaagggcactggcggtcatattgtaatgaaaacctacttccttcattgcatcatagaccttgcgtttgttgcccggccttacattattcttgccattcaaaacattggatacggttcccagggagactcctgcaacccttgcaacatcttttattgttgccatcttcctttacccccgcatactgtaatttatatttccaaaataaaacgtttcattttatggtcaaattatatcagtgtgcactgcatatgtcaataatatttgtgcaatatgtcgatgtgcataggtttgtgaagattttttttactaatatgcacaacttttatcgttttttaatgcaaataaatgaaacggttcatttttctcccggcgtacatcctttatttcacccccttgaccatatacattttaagacacgctctagtattaaatgcttttatatgttagaatgacgaaagaatatgctttacacggaaaggaacagcagctgttatgtcagaaatcaaagaacaaattattgagtcaaaaccgttgcgcgagcaggttgcggatattgtcagaggtatgattttaaggggcgatttaaaagcaggagagcaaatcagtgaacgtaccattggccagatgcttaatgtcagcaccacccctgtaaaggaagcatttcgttccctgcaggctgagggccttatctatacgcgcccgcgccgcggctcattcgtatccgagatatcgattgataatatgctggaaattgcttttatgagaagttcattggaaggcgtggccgcatattatgctgctaaaaatgccactgacagccatttagctgaaatgggcaggatattggatatggtatatccgctgctatcccttaaagatgagaagtcactggaagagattcagcagtacaatatttcttttcactcagtcatccgccagacatgtaataataactatcttgtccatcagatagaaaccctgcgcaccattgattatagtttccgcaaagcagcccatatgaaatatattgaagagccaatccccgcccaccaggagcataaggctatacttgaagcaatttcttctcacaattcctcgttaagcgagaagctgatggtttcccatatccgccgggtagctctgttcgttgctgactgtgcaaaaaaaattcaataattaaaaaaataataaaacctattgacaaatccattttatcgtgatagtttaatattacaccatctgatataccagatatcagatatcacaaaactatataatatggaggtcaacacatgaaacgcagcgatttagtaaacgtatttggtacagaacatccggtattaggaatgattcatcttcctccgctcccaggctctccttgttacagcggtaatatggatgatgtgattgcccatgcactgcgggatgcagaaactttgtccggcaatggggtcacatccatgattattgagaatctgggagactatccctattacccggaaacgacagagccggaaacagttgcggcaatgaccagggttgcactggaaatccgcaagcgttatgatatgccgctgggcatcaatatcctgagaaattcatggaaagcagccatggctgttgccgctgctgccgactgccagtatatccggttaaatgtccttacagatgccactgtaactgaccagggcccaatcgtaggaaaggctcatcttttagcaagataccgtaaaagtattgatgctgaaaatgttatgattttcgctgatatttactgcaaacatggagcacccatgactccaagaagcctggataccgtagcaaaggaaatgattggacgcggcatggcagacgctttgattgtagatggcgcagactcttcccagcccgctccaatggaaaaaatccaggcagtccgcaacgcagttcctgacacgccaatattcctgggcagcggaatgacagtcaataccactgactatctgaaagttgcggacggctgtgtgtttggatacggaacaaaacctagcggagatatgaacgatcctgttgacggaccaaccgtgaagcaattcatggagcaggtaaagcagctgtaatgaccttggtccggcgttcattcactatccctactatttggaatatgggcatggtttgctgaaaccacagggcttgtcacttgggcaggcgcagctggctgtactacatattttgcctgctgcggctgcggacaggatgcacagaaaggtatctggtctaatttaagcggtattttctgggcgtccttgtccctgtggctgactgaccaaaatgtgaatccgtacctgctcatgactatctttacctttatcatgtgcatacagagcattcatccccggctgtcctttacctcaggtacctttatcggatgcttctgtacatttgctgctgacggaccgtccacagcattgattctttccctgcttataggcaacggaatcggacttgccagtatatatttgtccgacctgcatgccgcgcatcaataccgtttgaacaactgaatagctgaacaaccagatagagggtatgcccagaaccttaataccggttccgggcataccccctcttcattttaaaaattattctgtttatatggttcagcgttcatctgcgtatgccacactttcccgctccacgacccgggtttctaacataatgtgacgtttgtcttccggaatagtttccccggccagaatccggccaagaagcctgaatgcagtaacgccaacctcatatttaggttgaaggaccgtggtcagggatggggtgcataatttacccatttcaatatcatcaatccccataacggatatgtcagcagggactctgtatcccatggactgaactgccttcattgcccctatggccatcatatcgttggccgccaatatagcggtcggaaccgtatccagcctgacaaactctttagcaattgcgtatccgctcttccagctgtaatccccataagctacatactcagaacgataagatatgtttcgggattccagacttttttcatatgccttcattttgccaaacccggaaggcgattccataagcccgctaataaaagcaatatttctatgtttgtattgaaaaagtaagttcatggcttggaccaccgccatatatccgtctgtactgaccgtcatgagttcctggtcacagcggtaatcccaatcttctacaacaagggcaatatggctgttcagcctgcgcaagtcctcctggccggatttgggttttagcagtatgattccatctactcctttactcagaagagcaccgatataattcctttccttttcctcgtcgcggtcactgttgcaaagaaatacggtaaatcctgcttttcttgcttcgtcctccacgccccttgccagctcaggataaaagggattgacaattgtaggtataatcagccctatattttttgttgtcttagtccggagtgcgctggcagtcatattatactggaatcctaactggtcaactgccttatataccttctctctattttgcggacgaacactttcctttccattaagcacattagaaaccgttccgatggagacttgggctactcgtgcaacatcctttattgttaccatttggttcctccctgcagtgaatgtaacgattcatcattttctccctcatggtaacatcctttttacattccgtcaactttgttttataccagatactggcagaagacaggctgaccccgttgagactccttcaactcctactccacaaacaacgccgtggaataatacctgtccccgctgtcaggcagcagcacaactatggtctttccttcattttccggccgctttgccacttctatggcagcatacagggcagctcccgatgaaattcctgtcagtagaccctctgtccgggccagcatctttgctgcggcaaagggagcctcattgtccacggttatgatttcatcatatatatgggtgtccagcaccttgggaataaatcctgccccaattccctgaatcttatgggggccggcacttcctcctgaaagaaccggtgatgtggacggctccacggctatgaccttaataccaggattcttttccttcaaatatgtaccggtgcccgtaagagtgcctcctgttcccacggatgccacgaatatatctacctgcccgtccgtatcctcccagatttccggccccgtgctctccatatgggctttggggttcaccgggttgtcaaactgccctggtatgaagctgtccggtatctcccttgccagctcctccgctttttcaatggccccgctcattcccttctcaccaggcgtaaggacgatttcagctccatatgccttcagtatattgcggcgctccacgctcatggtatccggcatggtcagtatcatcctgtagcccttgaccgccgataccgcggccagaccgatgcctgtgttgcctgatgtgggctcaatgatgacggagcctggcttcagtctgccggtgcgttccgcatcttcaatcatggcctttccgactctgtccttaacgctcccggccggattaaagtattccagcttcacaagaagacgcgccttcagctgctccttcttctcgatgttggtcacctccaccaatggggtgctgcctacaagttcaatggctcccttgtaaatcttagacatagcttccaccgttcccacacaggcgtgcagggcctttcttttttattcatagttaatcagtaggttttctaggattatatgaccgaagctgctatttgtcaagtattttatgttgtgttacttccaccaggaattataaaccggcctggactgaagcttttcagcttatgggctccgccataacgccgtttgaatcaaaggtataggacaccccgtcaatatccatggttgtatcatgaatcatggctccattggggtcaagataataccaggctccatccacctgcacccaacctgtctgcttcacatatcccttcatataataccatctgccgtccacatgcttccaactatcggcaggaatcagagcgctgtaatccgtaaatgccagctcgatggttacattgccgttgatgccgtccactgtacctgtatcggtacactgccatatggtccggttgggataactgttgacagtcccgtacctggcataccatatatcgtagggaatctggctggtatccatgttcctggtcagccattcattgtttccgtataccacgggatgatatcccgcatcggatatagtcctgcagaatgcatttacattgtccgtaatctgctgcctggtgagcccgttatcaagaagatgctgggattccacatcataggcaatgggataggatatgggaaaatccttaattaccttcagcacgaaattggcctcgtcaatggcagtctccacgtccagggcctgggtatagaaaaatactccggtctgaatgccgttggcaaacgcctctgtaacgttcctgtcaaaataggggtctttatccttgtaataccccacccgtatcatggcaaatgacacgccgtccgccgctgccctggaccagtctatgccgttctcattggcccggttctggtacttggtcacggtgattccctttgccagcgcccctgcaatgggcgcccctgatgcatctgtatactgcccgttctccagtgtccagggctgtgctccataggctgctgccggagcgtacagggacatggcccctatgatggctgccgccgtgcctgccgccatacgttttcctgtttttcctaatttccccttactgattctgctcctgctgctgcgttccggcgttcccaatatcctcatctcatccacctcatactctcagatttcatatgaatccatgattccatattaacccatatatcttctttattttagcacaaaggaattgtcatcttgttgaggttttcttaatctttcctttcaacttaaaaatcaaattcattttcccagtcaaactcccctgactcctccaggcactggggccagtggctgcaccaatccggcaccccgggatgttccacccggtccaggctgggggtatatggctttaaatccagtacaggacttccctgccgggcatctgcatacgcaatgcggacaatgccggcgtcatggtccaggcagagaatctgtgcaacggtcagggcaatgggattgggcctctggggagagcgggtcgcaaatgtgcccattatatccggtgaatgcttataggggtgttccacctccagtatactccggctctcctcatcgtcgcagccgtcaaaccaccagaggatgtctgtatggctaaagccctccaggttcttaagagccgggatgaattccggaagtacttttataaacatgccctccccatccatttccatggtgccaatctgctttactgtaaattgattcatgctgaaacctcctttatttgatggcttcagtctaaaccctcacacggtgtcagagtcaatactctttgcaccggcgtctgtacttccgtaagaaaattccgggaatcggattcattgtaggcacctatatggcaaatctggcggcttgggccggccatctcatactggccatgctcctccagccagcaggcaaaggcgtgataggatgtcccaatattcttatacgggccgtaaaccataatacaggccatctcctccaccggttcagtttccctgtagcagaatccacccttatcctgtccccttttttccgccatgactcccacctcaatgtccaccccgtctcccgcctgttcctcattgtgataaatagccaggttgttaacgccaggggccagctctgcctgttcctcctccacaaatgcataaagccgttcccacagattcccttcgcagaaatggtctgccacggtttccctcagggataaaatcagatggctgggaacagacttcatggtcacgttataatgtgtctcaatggtgttctccataaaatccctcatggcagtctctatcttgcggatgcgctgctgttccagccggattgtatctgaaagctgcctctttttatcctccagataccctatcacatccccgctctcccagcattccagcacttccctgatttccgtcacattaaaatccatgtccctgagcaggcatattttctgcagggccggtatctggtccgtggtatacatccggtatcctgtaaacctatcaatagcagcaggctttaaaagtcccgcctcatcatagtaacgcagcatccttaccgacaccctggtaagctttgaaaacccgccaatccggaacataaagccgcctccctttatctgatgtattcaatatacactttagtataacggttctttaagcatacttcaatactcggtatgctccattatgatgtatctctaccggtccatgaccctgcagaatatcaccgcaaccacagtgctgataaaggtggccgccagggcaggacccacaatggcagtgggattcacgctcccgtactggctccggtatgcaatcatattcatgggtatgagctgcaatgaggatatattgataatgagaaacgtacacatctcattgctggcagttccctcctgcctggctgcactgccctttccagctgcaccgccctttcccgctgcaccgccctcagccgcacctgactgcctgcgtccctcctccacctttttcagttcctccattgcctttagaccggctggtgtcgcagcccatccaaggccaagtatatttgcaatcatgttgacgcttatctgtttcctggcctcgccgtccgggtccagccttggaaagagaaaggtgagtacaggtcccattctttttgccagctggtccaccagcccggaacggtgccctatttccagtaccccggtccacagggtcatgacacccagcatggtgatgcagagcgtcaccgcctcttttgatgcctggattgccccgtcggtcacagccgtcatctggccgtgaagcgccccccaaagtattcctgtcaatgtcattcccgcccatagataattcagcatgttttcccgcctgtttcatggcattcttattccattttattcccggccctgtagaatatacccattctgacccttgtctgaaaatccaatcccgccggcttttctgcccaatccttcccaaatattcataattgccccttctctgtaagaattattacactggcttgcgtaaaatttacagttcattacgtttacataacttctattgaccctggagcagctccatagtatattctcaccatgtcagtgatgacaacgtgcggcgccggccagtacaccggcgaaacggcagccgcatccccgaaagaatattgagataaaaaatatgaaaatgaatggactgattgacagactgaaaggagacatgattatgaagagacagacaaaatggttcctgattccatgtgcagccatggccctgaccctgggcagtgcgctggtatcatttgcagctaccggatgggccgaggaaaatggcgaatgggtctattataacaacgacgggagcaaggctgccgatgtatttaagaaatccggcaacaactggttttatctggattccgacggaatcatggcaaagagccggctgattgaggatgatgacaattacttttatgtcaactcagccggggcaatggtcaccaaccagtggcgctccattgaaaatgaggacgcgggctctgatgagccggatgagtggtggtactatttccaatccaacggcaaggccgttaaaaaatccggcagcagtgacaatgtaaagttcgtcacccttcccacctccaccggacaggccaagtttacctttgacgacgaagggcacatgctttacggatggattgacgagagcggggaaatgcttaccgatgatgacgcctggaaaagcggcatgtactattgcagcgataacggggacggacgcatggccaccggatggaaatacatcacggctgtcaatgacgaggatgatgacagggacggcgacggctactggttctatttctccaccaacggcaaaaaaacagcggacactgattccaaaaaaatcaacggccgcaaataccgctttgatgaaaacggcgcagcccactttgagtggtataacaatcccggtaccgcatcttcctctacggtgaacaaatactataacacagaggaggagtgctggatgtccaccggctggttcaaaacagttcccagcgaggacgtggacccggaggcccacgatgacggagaagcccactggttctatgcagaatcaaacggtgaccttgtaacagcccaaatcaaaaaaatcaacggacagtattatggttttgatgtaaacggcaaaatgcttcggggcctttaccgcattgaatttgaggagaacggaaagaccattaagtctgcggaggaaattgaggacgcggatgagattccggacgaggatgaagagggcgtattcgtatactactttagtgattcccctaaggaaggcgccatgaagaccggcaccatgaccatggaaatcgacggcgatacgtattattacagctttgagaaatccggcagcagaaagggagccggaacagacggcattgacaatgactccatctatgtaaagggcagaaggctggaggccgaggagggcaccaaataccagcccgtgacctataaggatgaaacttacctcatcagcacatccggtaaactggtcaagaacaagaagaacgtaaaggattccgacgatgtatactacaagacagacagcaagggcagaatcgtggattccggtacggaaaagctggactagggggtgtttggataaagtcccctcttgacagcccccggggtacataaggtatactggtactgcaacgtaacagggcggcccggaatccatcggattcccggaccgcccctaaccggttttataacccatttcgttttacaaccatatacagaaaggacgttttattatgaagcagctgaagaagctggcctgccgcactgtacaggaattatccgtaacctttcctccaaggactgtgttatccattattctcggtacagccattaccacctttggtatctacaatatccaccagcaggcggatataacggagggaggtatcctgggattgattctgcttttcaatttctggctgggcatgtcatcttccatactgtcacctgtactggatgccttaagctatgcccttgggttccgtttcctgggcaaggaatttctcaagacttccatctttgcaactatatgtatggccggatttttccggctctgggaactgtttccgccggtgcttccaagcctggccggctatcctctcctggctgccctggcaggcggatgctttatcggtacgggctgcggcctggtggtccgccagggagcttcctgcgccggggacgatgccctggccctggttatatccaaggtcacgggctgccgtatatccagggcatacctgctgacggacgtgtccgtgctagtgctgtccctgtcctatataccggcaggacgtatcgtatattcacttataacagtaaccgtatcatccttcctgattgacttcatacagaacttcggtgttcaaaaggaggatgaggacagcgataaagagacactggctgacaacggatagggatgggccggaaagccctgccctgttataccggtgaagcaatcctcttaaagggcatataaatttccagacagtacgtagtcctgtcctttgcaaaaaaggacgtcatatcattggcatatacgcgttccgcgggctccagtccatacttatgtgcccactggaccatcctgtgaatcatatcaaaatccggaagggtatactctgactcaatgatggtataaatacattccacctcatccgtcatggtatacagactccggtcaaactcttcacccagccccttctccagtccctcatagagcaggagctgggttcccttttcctccaggtcctgtcccgtgtaagtgaggacattataaaaataagccatatccagccccggaatggtggaggacagcttgaaccaccttctcagtccctcctgcaggccggaacagttggccatcacatatgctctggggaaattcctgatggaataccttcctatgcattcctctatacggtttatatccttttccaccagcttaagcctcataattgcctggctgtgccgcctgagagcctcctcctcctcggccatgcgctgacggacatgctgtctcatggcggatgtggagttctgcccgctcataaggccccctatctcctccaggctggtattcatctttctgtgataaagtatgtacatcaatctgtagatatcatcctctgaataatatctgtatccattttcctttttatccgcacggataattccctttttctcataaaaacgcagggcatccctgctcatgcccaccatctgggcaacgtcaccaatgagataccccccttgtttctctgccaacgctttttccatcttcgcaccctctgtttcattcagttttttcatagatatattttaagaccttcccttttgagggtcaatggccaggtggaaaatgaaagagaaccgtaataaaaatgacagatgaaagtgctgtggaatgtctctggatatccgatggtggataatgtggataacttgtggatatctttgttaattatctggggataaggattgcttctttgctgcctccattgggaatttattgcaaaataaggaaaaaagagccggcactaagccagctctcctgttaattccttcatgacgttatccacagtatcgattgtttcagcgcggtaagcattacttccgcagaataacaggccatggtctgtatccccttgcgccgcattgaccaatgccatggtaatgcagtagggaatggtcctgatgtcgcagtgctccaggcactggaagcaggacttgatggccggcctgctgccttcctttatctggctcaggaatggatttaagattgccctgcccggcattcccacgggactcttggtgatgacaatgtcttcctttcctgcctttatataagcctgcttatatgcatccgaggcatcgcactcctgcgttgtcacaaaccgggttgcaacctggaccccgtcagctcccagctcaagctggtgcatcacatcctcatgggtatagatgccgcctgccgtgaccacaggaatatgcctgccgtacttggctccatattcctcaaccaccttcatgaccgcctttacctcccggtcataggcatcctggtcataggtggccggcacatctgcggtatccgctccataggcggatatctggtccagcgagaatcccagatggcctccggccagcggtccctccaccacaaccaggtcaggggcaatgtgacatttcctgtcccacatcttgcagataaccatggctgatttggcagatgatacaataggcgccagcttaatcctgcgggccggcttttccaccatctcagcataggccgcttccacgtattcaggcagggacaccggaagcccggctcctgatatgatgatatcagcgcctgccttcacagcctcctttacccacatatcatagtgcttggtagctaccatgatgttgaaaccaatcgctccctggggggcgatttccctggccagcttcatctcccggcggatggaccttaggtttgcttccacgaaattggtggtgaaatccggctccctgaaaccaatctgggcagctgatatgatgcccatgccgccggcctttgccacggctccggccagcctgtgcaggctgatgcccacgcccattcctccctggatgattggtttttcaactactaaatccccgattaccaatggttttaactcactcattacattctcctaaatctctggtacctgtgctccctaagctcctcatcgctcatggcgagatacgttttaaagaactctgccatggcgctgtccatatattcagcgagacggtagagattgtccgtgcatgctggttcttcctcaggcacgatacgttcaatcagctgaagctgtaaaaggtccctggccgtcaccttcatgaccttggcggcatcgggcgcttttttgctgtccttatacaggatggaggcaaagccctccggcgaaaggatggagtagatggcattttccagcatccacacctcgtcggccacagccatggccagcgctcctccgcttccgccctctccgattacaatggagagtaccggcactttcaggtcggaaatctcgaacaggttcctggcaatggcctcgccctgtcccctctcctctgcctccagcccgcagaaagctcccggcgtatccacaaagcagataaccggacgcccaaaggtctctgcctgcttcatcagacgcagcgccttgcggtagccgtcaggggacggcattccgaagttgcgggtgatattgtctttggtgttcttgcccttctgctgtccgatgaccgtcacaggcatgccgtggaacatggcaacaccgcccacaatggctccgtcatccttaaaataccggtccccgtgaaattcgatgaattcatcaaacagggcgttgatataatccgtggcaacgggacggtcggactttctggagagaagaaccgtatcccaggcggtttttccaccttcagccccagaatgggctggtttatccacaaaggttctggatgtatccacgggattctttaattctatattcattttgtggctgcggtgcatgtacagaatctgtccaatgacccgcttctggtccttccgttccacaatcttatccacaaaaccatgttccagaaggaattcagaacgctggaacccttccggcagcttctgcccaatggtctgctcaatgaccctgggacctgcaaatccaatcagggcgtgaggctctgccaggatgatgtcgcccagcatggcaaagctggccgtgacgcctcctgtagtggggtctgtgagcacgctgataaacagctgccctgcctcatgatgacgctttagggcagcggaggtcttagccatctgcatcagggatacaatgccctcctgcatcctggccccgcctgagcaggcaaagagaatgaccggcagtttttccctggtggcgcgttccactgcatcggtaattttctcacccaccacatggcccatgctgctcatgatgaaacgggcatcgcagacacccactacagccggattcccctcaatcctggccttacccgtgacaatggcctcattgaggcggctcttttccctggcagccagaacctttttctcatagcccgggaagttcagggggttggaaaaaggcatctctttgttccactcctcaaaggttccctcatccacaagcatctcgatacggcggtatgcatgaacacggaaatagccgttgcacttgggacatacgtagtaattgttctttacgtcttccacatagattggctgcccgcacttgttacatttgcgccataatccttccggaatgaccggttcctggtcggacccggcctgcggcttatatttcgtatctatttttgtatacgtttttttgaacatgttccgcaacatagcaatttcctttcattcataaacccacagagcaaaatcaccgcacataatccgggaaatgcttctcaataaagctggtatctgtatcgccctgctggaatgcatcattttccaggatttcgtactggaaattgatatttgtctcgattccctcgatgattacctcgcccagggcgctgcgcatcttggagatagccgcctcccggtccttatcatacacaatcagcttcatcagcatggagtcgtagtttgcaggcaccttgtaatcattgtagatatgggtatccacacgtaccccgttgcctccgggaatgtgcacattggtaatgcgtccgggacagggcatgaaattcctggccggattttcggcattgattcggcactcaatggcatggccctcaatccttacatcctcctggctgacgcttaaaggctcccctgccgccacgcggatttgttccttaatcaggtccattcccgtcaccatctcagttacagggtgctccacctgaattctggtattcatctccatgaaatagaaatttttatccttatccaggaggaattcaatggttcccgcgttctcatagcccactgccctggctgcctttacagcggtgtcgcccatggctttgcgcagattgggggaaatcacatcacagggcgcttcctccagcaccttctggtgacgcctctggatggagcagtcgcgctctcccagatggaccacgttgccgtgcttgtcggccataatctggaactccacatgtcttggcttttcaatgtatttctcgatgtacatggtgtcgtcggaaaagcccttcacagactccatctgggccgcatgaaagagctccgtaaagtcctctgcgctcctggaaatcctcatgcccttgccgccgccgccggatgatgccttaatcatcaccgggaagccgatttcttttgccatggccagaccgtccgcagccgtatggaccggctccttgctgccaggcaccactggtacccctgcttccatcatggtctttcgggcttcggatttattgcccatcttattgatgatttcagcgctgggcccgatgaatgcaatattgcactctgcgcacagcttggcaaacctggcgttctcagacaggaagccgaatcccggatggatggcgtccgccttcatggccaccgtggcagccagtatcctctcaatattcagataactatccgtggaggctgctggtccgatacagatggcctcgtcagccagcatagtgtgaaggcagtccctgtcagcctcggaatatacggccacggtctggattcccatctcacggcaggcccggatgacgcggaccgcaatctcacctctattggcaatcaaaatcttgttaaacatcggcattctccctcgattccctaacctaccataaatgtcagctctgcgctcaccgccagcttcccgtcaaccgttgcagtggctttgcccacgcctaccggtcccttctgcttgatgatttcacactccagcttaaccttgtcgcccggcactaccttgcgcttgaactttgccttttcaattccgccaaagtaagccacctttcccttgaacccttcctgggacagtatggcaaccgcccctgtctgggccagggcttcaatcagaagcacccctggcatgaccggctcctggggaaaatgtcccttgaaaaaggactcatcataggtcacgcatttgtatcccactgcgcgcacgcccggttccagctcctctatacagtccaccagcaggaaaggatgcctgtgcggtatgatttcctggatttcttttactcccatcaacatatccttaaatccctccgtcttttgatgttacttgattcggaacaacggctggccgtattccactacttcctcgttgttcacaaggacagcctccactatgccgtcgtattcgctttcaatctcgttcatcagcttcatggcctcgatgattcccagtacctggccctttttcacggtatctcccgcctgtacaaagggtgctgcatccggtgaggaggcattgtaaaaggttcccactaagggggaggcaactaccttgtctgaaccgatatcagcgcggtcagccgtgtcctgggctgcctgaggcattaccataccctggggcatcatggacgggcctgccaggccgttctgcacagccgccatctgcacagctgccgcatcggcggacggggcgcttaccgtcacaatctgaggcatctctttttcacgcttcagggaaagcttaagctccccttcctttaactccaggctggtaagcccattgtcggaaactgcctgcatcaattttatgatttcatctacgttcatagctcatggcctcctattattcgctgaacttcttcacaatcaggctggcattgtgtccgccaaatcccagggaattgctgatggccacatccacgttcatggatacgccgtcgcccatggtgtaatccaggtcgcagccctctcccggtgtcttcagtcctaccgtggcatggataaatccgtcctggatggacttcacacaggtgatgaactccacgccgcccgctgctcccaggagatggccaatcatggacttggtggagttaatcttcacctttcctgcatggtcccctaaagccagcttgatggcctttgtctcaaataaatcgttgtgatgggtgctggtgccgtgggcgttgacataatcaatatcctctgcctcaatgcctgcgtccttcatggcattctccatggcgcgggcagccccgcttccgtcctctgccggggaggtaatatggaatgcgtcgcaggtagcgccgtatcccaccacctcagccaggatattggctcctctggcctttgcgtgttccagggactccagcactaccacgccggctccctcgcccataacaaagccatttctgtcctcatcaaagggaatggatgccctggaagcgtcatctgtggtattcagggctgtaagggatgtaaatcctgcgatgccgattggtgtaatgctggcctctgctccgccggccaccatcacatccgcctcgccgtactggatggaacggaatgcttcaccgatggaatgggttccggttgcgcatgcagttaccacgttgaagcattttcccttaagtccgaactggatggcaacattgcctgccgccatgttgcttatcatgaggggcaccagaaggggattcacgcggctgggtcccttctcattcagcttcttcacatccttttccatggcctggagggatccgatgccggaacccacgcacacgcctacacggtaggggtcctctttctccatatcaataccggactgctccagggcttccttggaggcagccactgcaaactgtgaaaatgcttccatacggcgggctgccttggcatccatgtactgctttgggtcaaatccctttacctcagcagccagcttgcacttatagtcggttgtatcaaaatacgtaatgggtccgattccaactgtcttatccttaagtccctgccagaagctctccacatcatttccaatgggagtaatggcacccataccggttactactactcttgttttcatactaatctcactcctgttcttttacagcctggatacatggttccaggtcatcctacatggccattccgccgtccacactcagtacctggcctgtgatatatcctgccttatcggaagccaggaaggcaactgtctccgcaatgtcttctgtgcttccgaaatgtttcattggaatctgctccgcagcagctgcctttacgctgtcgctgagaacatcggtcatctccgtggtaatgaaaccaggagccactgcattcaccgtgatgcccctgctggccagctccctggcagctgatttggtgatgccgatgacgccggccttggccgcgcagtaattggcctggcctgcattgcccagaacccctgatacggaggagatgttgatgattcttcctgccttctgttttaacatctggcgggaaatatgtttgatgcagttaaatacgcccttcagattggtattgatgacagcgtcgaaatcttcctctgacatcttcatgagcaggttgtccctggtgattcctgcattgttcaccaggatatccaggcggccatatctggaaaccacgtccgccatcatcctgccgcagctctcaaaatcagaaacattgcactgaactgcctctgccctgcctcctgctgcttcgatttccttcacaacttcctctgcctttgccgcagagccattataattcacgattacggctgcgccttcccggcccagggtaagggcaatctggcggccgattccgcggcttgcgcctgttaccagtgcaatctttccttccagcatatagtctctcctcctgattatgatttaagtgcttccactactttacccatatcttccaacgtttccacattaaaggtctttacgtcccggcttatttttctcatgaaaccggccagggtcttacccggaccaatctcgatgaaggtgttcacgccgtccgcaatcatggcctccacgctctgctgccatctgacagaggatgaaacctgccttgtgagcagctcctttacctctcccgcattctttacatactgtgccgtcacattggccacatagggaatctgcggctcatgaatctccacctgggaaaggacctggcccagcttttcccctgcggctgccagcataccggaatggaagggtccgcttacatttaacatcaccgttctctttgctccggctgccttcagcttctcacacgcttcctccacggctgccttctcaccggaaattacaatctgtcccggacagttataattggcaatccacacgccttccatggctcctgtcacttcctcaatggctgcagcgtccagggccagaatggctgccatggcgccctgtcccacaggtacggcctcctgcataaatattcccctctggcggactgtgcggatggcatcctcgtcactcatgactccggccgctgccagggcgcagtattcgccaaggctgagtcccgccgccacatccggcctgattccattttcctccagcacgcgcatcatagcgatgctggcggttaccatggcggcctgggtgtattccgtgatatccagcctgtcattttcctcaaagcacagctccggcatggaaaagcccattaactccgttgccttgtcaaagattctttttccggtctcagtctgctcgtagaaatccttacccattccgcaggcctgggctccctgtcccgggaaaataaatgcaatcttgctcatacctgtaatctccttatcctgaatcctgtcccaatcctctagttccagcccatcagctttcctgcctgggccatgatttcctcaatcatctccttgcaggtctgctccttggatatcatgcctgcaatctgtccggccataacggttccgccgttcacatcgccctccatgactgccttgcgcagggttcccagagtcaggtactccagctcctcaaaggaccggccttcctgctccagtttgatatactctctggtcatctggttcctgagtcccctcactggatggccgtggctgcgtcctgtaaccgtggaatcaatgtccttggccttgataacgcgctgcttataattttcatgtacaatggattctttggctaccacgaacctggttcccatctggactgcctcagcgcccagcatgaaggctgccgccatccctcttccgtctccgataccgcctgccgcgataaccgggatggatacagcgtccgctacctggggcaccagtgtcatggtggtctgctctcctatatggccgccggactccattccctcagcaaccactgcatccgcgccgtatttctccatgcgacgggccagggccacgctggcaaccacgggaatcaccttgatgcccgctgccttccacatatccatatatttttcggggtttccggcaccggtggtaaccaccttaatgccttcctccacaaccacctttgccacatcctccgcatgagggctcagcagcatgacattgacgccaaaaggcttatctgtcagctccctggccttgcggatttcgtcccgcaccacttctcccggtgcgttggctccgccaatcagtccgaaaccgcctgcctcggatacggctgccgccaggttgtgttctgctacccaggccatgccgccctgaataataggatattcaattcctaacatttctgtaattcttgttttcattgttctacctccagttctacatttcctgggctctcccctattaaagtaacagcgtgcttcaattcatccacacgccgttgtcaaaccctatctgctatttaagcctctacgcccttgccttttaagtagttcataacctcgcccaccgttgtcagctgctctaagtcctcagcaggaatctctacggagtactcatcctccagggccataaccagttcaaacaggtctaaggaatcagcgcctaaatcttctttgaaggaagaagcctctgtaacggtatctgcctctacgcttaactgctctgcaataatttctttcatcttctctaacatgattgttgttctccttttacattttcttgatttatattttaattttatttttaccactctataagggctgcaccccaggtaaggcccgcgccgaatcctgacagcaccactttgtctccggctgccagcatacccttccggttcatctcatccagcagaacaggaaccgatgcccctgatgtattgccgtagtgttccatgttaaccgggaaacggtccacatttaccttcagccgctttgctatggattcaatgattcggtaattggcctgatgaatggcgaaatacttcacatcctccacgcccacgccggtatcctccagcacttcaattatgcactgcggtacctttttcaccgcaaacttaaatacctcctggccgtccatggtcatatatccaagctctggcttcttccccataaggaaattcccgttggtcctggaaccgcaggtcagtaccccgccttttgttccgtccgagtgcatgttcattcccaggattccggtcacatccgcctttaccaccactgcccctgcgccgtctccaaacaatacgcaggttccccggtccgtccagtcaatcagcttgcttaacacatccgcgccaatcacaagggccgtcttatagatgccgctgcttaagaatgcatgggctgtgttcagtgcgtatacaaaaccggtacaggccgcgcttatatcaaagcaggccgcatttaccgcacctatcctgccctgtacctcgcatgccccattggggaaacagaaatccggtgaagaggtagccagcagtataaggtcgatttcctcaggctttacacctgcattctccagggcgttgactgaagcttcagccgccatataggaggtgctttcgctggtggcaatccttctggcccctatccctgtgcgactgcgaatccactcatcattggtctccacaatctttgcaaggtcgtcattggtcacaatctgctccggtacatatgaaccggttcctatgattcttgttgtcattctacttacccgtcccgaatccatcagcaatcagcggactcatgccttccttcttttgcttgctcagaggaaatactttgaacatcaaagtaatactacaggaaagataagtatttgtcaagaaatattttttgtcgctttttgttaactttactgttctctgacatttcttaccaattctgacatttacatatattgactttgctccctgaatttggtaagttaaacttgtacaaatggggcgaatacaatttaacaagggggtattaaccatgaaaaccacaggtgttatccgtaaattggatgaactcggcagaatcacccttcccatcgaattaagaagaagccttgatttggatgtgaaagatggtcttgaaatcacggtccaggatgactgcattatcctgaaaaaggcagaatgtgccgacatattcaccggaagcactgacgacctgctggaatacgaaggcaagaaagtatcccgtcagtccgttgttgctctggctaaattggccggccttaatgtcaccgagtaatcaaaacatgtacatagagagaacctgcggctccttctcaatatcagaaggcatctaagccgcaggttctttctatattattactgctttctatactattaccttctatattactgcatctaatcacagaagctgctggtacacatcccgctttgtgattccccggtcctttgccaccgccttcatggcttccttcctatccataccctggtctgtataataggacatatgttcctggatttccatctcttcccagcggcttatctgctccttgcggagctgttccagaggctttccttctattactatgacacactcccctttgggctcctccacctggtagtgttccagggcctcccggaacgtggtcctgtaagctgtctcatatttttttgtaagctccctgcatatggttatgttcctgtccccgagaacctcatataaatcttcaagggtcctcaccagatgatggggcgcctcatacacgatgatggttctggtctcctgcctcagctcctccaggattctggcccgttccttcttatcccccttctcagagggcagaaatgcctcaaagcagaatctcctggtggaaagcccggacatggtaagggccgtgatgcaggctgccgggcccggaagggaagtgacccggattcccgcctcataacactgccttaccagctcctctccggggtccgatatacctggggtccctgcatccgtaatcagggctatgttcagcccttcctccagctgacccaccagatatctggccttgtccaccttgttatactcatggtagctggtcatgggagtctttatatcaaaatgattcagaagcttgatgctgtggcgtgtgtcctccgcagcaatcaaatccgcttcctttaatgtcttaagtaccctgaaggtaatgtcctccagattgccgattggcgtggcgcagagatataatgttcctgccatgagcctctcccttctgtccgctgagccccgtttgtccgtccattggactcctgccctcgcacatcatataatccgtcaatatccgtaggtggtccgtatctcctgggaatactccccattctggtcaaaaacaataaccggggcttccatcttaaggagaggtccccctcccctcacggcctctatgagcaccatgttggcctccctgtccccataggggtggaccatcttcatgcgctttggctccagtccatgatgtttcatggtggtaatgatttcaatcaggcgcctgggcctgtggaccatgtagaaacgtcctccgggcctcaaaacccgggttccctccctcaccacatcctccagcgtgcattttacctcatggcgggcaatggccttggcatcctccggattcttaagtccatgggattcattcatataagggggattggtggttaccacatcaaaagaagccagtgcaaataaactgctggcctccgctatatcgccggtgacgatgtccaccttgtcctccagatgattatatgtcacgctccgcctggccatatccgccgactcttcctgtatctccaggccggtaaaatgccttccctctgttttggcggtcagaagaatggggataatgcctgtacctgtccccaggtccagcaccctctccccctttttcaccacggcaaagccggacagaaggacagcgtccatgccgaagcagaacgcgcccttcctctggatgattccataatgattgcgctgcaaatcgtctatccgctcgtcgtcccgcaccataatggtcccttcctgacgccaggtatgtttcacggtaactgtatcagttgtcatccagcttcgactttccttccttcttttcaagggcctccagctgtttcagctctgcatccggcgtgtcgcctccgtgcttttccccgcctttgccctttttcttcctgggcttgaatttaagctggtctaccttgtattccctgatttccttttcatcgcgctccacggtcacaatgacctttacctgctggcgcagcacgttgacactgtgcacctcgccctttagcccgtcattggtggtcacgtaatcccccggattgggcagcttgctgtttaatacctcatatgtttcctcttcattcttaaggcagcacataaggcgtccgcacacccccgatatcttggtggggtttaaggacaggttctgttccttggccatcttgatggacacagggatgaattcggacagataggagtggcagcacagcgctcttccgcagatgccgatacctcccatgatttttgtctcgtccctgacccccacctggcgcagttcaatcctggtcttaaacacactggccaagtccttcaccagctccctgaaatcgattcttccgtcggccgtaaagtaaaacaggaccttattgttgtcaaatgtatattcggcgtcaataagcttcatctccaggtgatgctttctgattttttcctggcagattttgaaggcatccctctccttctgcttatttctggcttctgcagcctcatcttcatccgttgccatgcggatgactgattttaagggcggaaccaccttggattcatccacttcccggtttcccagaaccacatacccgtattcaatgcccctggccgtctccacgataacgtggtcgcctgtcttaatctggcggcctgcagggtcgaaataatatatctttcctgcggtgcgaaagcgcaccccgattactgtaatcattttatgttctccttctcttgcagccccggcacgttaattctccttcatggtgagaagcatcagctccatgaccagttcggtgttcacgttggcgtccagcctgattctggccttgtcaatggcctccagaatccgttccagaccgtcatacccgcttgtggtgctgacactcttgacagtagagaattcgtccttgaatatcagcaggttaatatcctttgtggtcttatacatcaggatatcccggtaccacatctgcataaagtccaggcattcccggatatccagattctcctccttaaccttgcggatgtagtctaagagttcagatatatccgtatccttgatgtgtttcagaaggcggagcatctctttatacataatcccaaactcctctgactgggccagatgaatggctttccccaggtttcccctggcaaaggccgcatagatatcggcctggctctcatcctcccccagcgactggaccagatattcctttaccactgtatcctttaagggtttcagcttaagctgcacacaccttgacaggatagtgggcaggaacgagtcctggttggtggtcagaagcaggataactgcataggcaggcggctcctctatggtcttcaggagggcgttctgcgcctgtaccgtcatcttttccgcttcatccactatatatatcttataataactgctgtagggacgtacctgtatggtatcgttaagctgttcccttatatcatccacgccaatgctggcgggcttctcatgtgtcacgtaaatcaggtccggatggttcccggaaagtacctgcttgcaggcatggcactgcatacagggctctgccattcccttctcgcacaacaggctgagggcaaatgcattggccagggatttccttcccattccggcctcgccgctcagtatataagcatgggaaaccttccctgtctccactgcgttgcggaaatgttcctttatctgttcatgtcctaatatatcgttaaatcccaacatagtgattggctcccccttgtgctgccggcctggttttcaaaaccaggaaaatgcctgaaaccggtctgtccggacctctgccctgatggggacaaacgtcctcaataagtatagcataagaatttttcaatgtatagtactacatttttccctgttttccctatttataacctatctgcatctatcctgatactccgacggggacacccccagaatcttcttaaactgggcgctgaaataagctgtatccgaatatcccacctggtccgccacctcgtacaccttcacccggcagtccttcaacaggttcatggccacctgcatccggtaataggccaggtagttggtaaaggtataatcggtttccttcttaaagacccggctcagatagccttcgctgatttccaggaaggaggccacggtgctgatagtaatatcctcccggtaatgctccctgatatactgggtggctgcctccacgtacttattcttggttttccggtccgaatggaaccggaggaccggggcggcatctgtttcctcctccctggccggacgctcttccatctgctccctgatgtgttccactgcatgttccaaatctccgtccctcaaaggcttcagcagataatcgctgacgcccagccgcagggcgctctgggcgtacttaaaatccccgtaggccgtcaatatgataaatttggcgcggcagccctgcttacgcagttttgttatcatctccacgccgtccatcctgggcatctttacatccgtcacaataatatccggtgaaaggcgcactgccagctccgccccttcttccccgttggcagcctcccctgcaatgacgcagtccagggccgcccagtcaatggtcaggatgattcccctccttaccattgtctcgtcttccaccacaatgaccttatacatccggcacctccttctgaaccggcagcctgagtgtaatggtggtcccatcctccgtaacagccgccctcataccgtattcctgtccgtaatatattttcaatatgttgatgacattgtacaagcccagatggccgtcccgcttagccggggaatcgctgttaatccagtccaccatgtcctgtcccatgccgcatccgtcgtctgtcaccgatatgttcagtatcccttccttctggaaggcatagatacagatatagccgtgctcgcatccgtccagcccatggataatggcattttcaaccaggggctgcagaatcatcttgggcaccatgcagtcctccagctggtccggtatctctgtctcgtacagaaaccgtcctgtaaaacgtattttctgtatctccacatagctctctatggtctccagttcctccctcagggtgatgaagggccggctggatatgctctttctcaggataaccgccaggttttccgccagcacggcaatctccggcacctggttgattctggcgctccacttaatggaatccagggtattgtacagaaaatggggattcagctgggtctggtacagcttaagggttgtcttatttaagtccttctgcttctgcaccgtgtcctccaggtatttctgcaggtcaccggtcatctggttaaagctctctgtcagcctgcctaattcatcctggcggctggtatggatgcggatggataaatcccctttcttcaccttggccatggctttgtccaacaggctcaccggctggcccatgctccgggacagcgcgcctgctataataaggcagagcaccagccccagaccggacaaggctaaactcaccgtacccatggtgcgcacagcaggagcgctgatgggagccgaacagcgcagcaggatgtaaaagcccctggaaggctccctggtccacagatatctggtgtatacccctcttttctccgttcccccctggcctgaaatggtatgttcgataatatcattgatttctctttccccgtactcaggcctggaacagtaaagtggtttttggtgggaatccagcaccagcagggtgtcaccggatgaatagaagccattcagcaggttatcaaaattttccctggtaaaatccagcaccacatatccggttctggctccatgggcgctctccagcgaaaatgctccctgcatcaggacatcactgccagaagaggaaaggtaggggtcagtcctgtaataggtgattcccggtttctccgacgctttgttgagcagtccccagctcacaggcagacggctgcttttaggcgcagtatccgtggtaaaacgcagttttccgcctgcatcgtagatgctgaactgggcatggctgtaaatctcctggacagcctggtacatggacaggtataaatccttctggaactctatggttttattgtcaatcataacccaggcagcagaaccgtcctcagtcagtgtttcacaggcgttctggcagttctccagcagctgggcaaaccgttccctgacttcctccagctgctggtttccgtccacggttatctggcggttaatggaggcggtgaacaggcgcatcattacaacgcttgaaaatgtaaggggaaccagggctaccaggaggcagcccaggaataccctggccttaaaagagagtctccgataccatctcattccacaggcctcccttccctacgggacagtatgccgttccacctggccagtacgtccttcttttccctggaaagctcctccaggtccatctcaatcagcggaagcctgccaatgggcgacagtccgggcagcggcggcacatcgcttctcacggacctgcggtttaaatccgataccagaatccgctggacatccctgctcaccgtaaaatccagaaactgcctggcagcgtcagggtttgtgcatccctttacaatggctgtgccgtccggaagagccgtggtgccctcctgcgggtaaatatagtctatatccgctccctcagacagcagggcctgggcggactcctccatggtgaccccaatggaataccgcccgtccaggataccggcatttacctcctgcatactgttcagggtgccgtatcccaggttttccatgaactgttccagataatccccctttttctcccacgtatggacagccgtcacaagggcggaggaatacacatcggacctgcgcgggtccacaaaggcaattctgcccttccacctgggttccagaaggctgttccatcccaccggcagctcccggtacgtaaccacatttgtattgtacatgatgaccaggggcagggcggaaaaagaggtccagcggctatcctcacaccggaaattttctgttatgaatgctgcttccgggctttcatatacctgccaatgctcctttgactgttccagtgtctctatgccaaccccgaacaccacatcccaatcaggtccatcctcagcctccagccagcctgtcatttcctcggaggacccgcgttccacctttaccatcagattggtgcgctcctcaaactccttgatgatgggctcatatatctcttcctcctgggctgtataaagaaccaggtccggcacagcaggcatgggagctgactccggccccggctggcatgaggaaagaagggctgtgcagaaaaggcacaggccccttagcgccggatgcatccttcccacggcagttcttttcctgcctgcaattgtttttttcctgccagcggcagctctgttcgtatacatggcggcacccccgtgtcctatactaccggtagaatcagtcctgtttgctacattatatcaaagaaaaacatatttttccattgcggaagcccttgaaatcattcccttaaaatcattccctttgaaatcgttccccttgaaatcgttccttccccatgttacccttaaggcagaacgcaaagagtatcgtcaaaggggaggcagacaatatgaacgtgcagatgatagaacaatttatctgttccaaatatacggaccagcaaaaatgcgaggatggtctttttatcagtgatgacttcattgccgtcatagacggtgtcaccagcaagggggcgctgacatggccggtacagacagaaggcgcggccggtacccttccttccatgaccagcggccgctatgccagggaggtactggaaaaggcccttaaagccatgaagcccagcattgatgccgcctctgccatagaatatttaaaccaggctctggcagcagccggcaccagccgccgggattatctgagggaccatcctgaggaacggctccaggcagtggtcatcctgtacagctgtcacaacagggaggtatgggccttcggagactgtcagtgtatgattgggaatacgcttcatacccacagcaaggaaattgacagtcttatgacagaaatccgctgtctctatgaccaggcagaactgattttaggtgggtccgagaatgaattggcagagcatgaccctggccgggtctgcatccttcctctgctgcgccgccagtttctgctggccaaccaggactgcccctatggttatgatgtgcttgatggtttttccattcatgcccaccatgtatccatttatcctgtcctgccccaaacccaggtcgtcctggccagcgacggctaccctgcattaaaaggcactctggctgaaagcgaggaggcgcttagggcgcttctgcaaaaagacccccagtgcctccgggaaaacaggggcacaaaagggctggtaaaaggcaaccaaagctttgacgaccggacctatgtgcggtttatggttttataatcgggagctgatatgcggtaagagcgccccctgtataaacagagggcgctcctgccagttatcatttgtacattattttaatatatatattctcgcccttctctccccctgctcctgcaatatcccatcctctgacatctgcttaagaattcgtttggtagttgattcagcaagtcccagaatcgcgcgcgcctctttattggaaatcattccatactcttttacatggttaagaatcagtttctgccgttccgtctttatcggctttttaccggtcttttttatggaccctttatcggctttttttatcggctttttatcggctttttttatcggctttttactctttagacgatagagattcactctgaaggtatcaccaatttcaaaaaaatccggtttgggcaatccatactcatttgaccgctttagaatacggcgtattccagttccccattcctcaattaattccatccggctgaatacctccgcaaccgcacggttacgaattttagaacgcccgctcatagcttcctccagtgtcaggccaccataaagcattcccggagaggtgacttccaatctgtcatcataaagtgccacctgcacacaggaattatccatgaaattcctatgacactgggcattaataatcatctccctgattgaacctatcggaagctcataacgttccttacgaaccaacccgtcaatctccgcactccggcttatatgtcttaatacaaactgataggcaccttctatctgctcatataaaggtccacaaaactcctttttatcgataaattcatcacggtccattcccttaaagagagcgcattgaattttggcaaatgggaaataatcacttgtgagtaaaacaaacgcatttgtaggaagtatctcaccctctgcctttttcaaaattttccaatttaacaactgttcttttgtcaccctagatactgcattcttctcttcctcggtatctgccgcattgaccatataattgtgtatatcctgacataacttttctattgcctcatctgatacatggtatccaacacaggtcagctcatcccaggacaaatttagaccttccaactccagttccttaattttatattggtcagcgggacgggatgttcctgcaacacgaagataagtccccttctctttaccaatatgtttcagataatatggacggttggcacctggataaatttcgactatcacgatacacttaccgtcaattgtctggaatgttatgtccggaataatttgaggctcacaacaatcagaaatcccattggctatactatccattatataaaatactgcttctttatcaacaccaataattgttctggttttatcatcaatgccaatcattaacttgccaccgctggtattagaaaaagcaatgatggacttcatgtatttatcacttcttttcggaagttcggatttaaactctacattttttgattcaccttttaagatatcttcaagtgtcatctccaacgtctcacttcctttctatgcccaaattcaatctctcctgcgttttaccaatatcttatctcttcaagtgtacagtgaattattttatttgtcaaattatgcttttttccttattttcgtttgcctccatctgacaaatataatacacctgccaaagcaagagcgccccctgtataaacagagggcgcccttaccgcacctacacctattcacctacataaaaatccttaatctcgtattcccttaaagcttcctcatccggctcaaagccaagtcccggcttctggggaacatgcatgtagccatccttgtcaactaataccctgtcctcctccttaaggatataatccctgcggtcaaccgtccatacaggcgggtcaaagggatattccagatattccgcatcgctgacagcacaggccatatgaaggttggccagaagtcccacgccgttggaccaggtgtgcggacagaacacagctcccttggactgcacatagtcggcaatcttcttagtgcgggtaaagcctccgcacagcaccgtgtcaggctgatacacatcatagcttcccttatccgccaaatccctgaaatcgtgccatctgcggttcatctcgccgcctgcaatacgaatatccgtcatctcccgcaggcgggccaggttgtcgtaatccgcgtgatggagcggctcctccagccagtatacacccagcttctccagttccctggccaccttgaccgcttttttcaaatcccagatacgctccacatcccacggcattttccaggcctggttgccgtccaccatgatttccatcttatcgccaatagccttcctgacagcctctatgaccttgatatcctcccttacctcctcatgatggaaacggattttcattgccttaaatcccatgtccacatattccttagccttctcagccctttcctcagccggaatcctggcgccgcaggagcagtatgcctttatcttatcctgcttccctcccaaaagcttatatacaggctgcccgcatttctttcctatgatatcccacagcgcaatatccagaggccagcaccttccataatggaaatcaatgttgtcaatgaccttgttatggttttccatctcaaacgggtccttgccgataaagaatttctcatgtcccgcaaagcctgtcataaggtcgccggagccaattcccgtaattccctcgtccgtgtatacataaacaatggtagatgcaaactttacacggggattcgggtcccatgatgccaaaaatggcgggtccaatggctttgcatactgtttgatttcaatgcctgtgattttcataaaatacctccatacttatatatgatttttattttttctgtttaagcttatagcttcccgggcagctttcttatcccttaaccggggtctttctgatactcttaataaggatgactgccacggcagcgccaacgatacatgtaccgatgccgtacaggaacatggaacggtacccctggaccccctggtcaatccagcgtccaatcatagtgtacaggaacacgtccggaagataaccgatgcaggatgccataccggagaccgcgcctgtaactgaacggtctatctgggcctcatcaataactgcaaaataaatgcctctcaccgcgtacacggttacatttaacaggatgaagtcaaagacacagagcatggccagcgaaggctgctgaggtgtcagcaggaatacaatcaggaaggcgatgatagccgtatatcccagcaggactgtctttatcctggagccaatcttatcagccaggaaaccgcctgtgattccgcctgcaaactgtatgatgtatcggatgcctcctatctggacgctgaaattcttggacatgccgtatacggataccatgtaaggcggcaggaaactgaggattgcgtaaatggaataagcggtaaagattatgagacaaatcatccacattttcggcatcagaagtacgctcttaatctgctgcaccaggcttgtgccgcttgccgcatcctccttcttatccttaatcaggaaccagagggcgataccaactatgattgccagaagggcataggagcggatcacccagctcagtccgaacttgccgcctcccaggctgttaaaaagtcccagaagcacaaacactgccgtggccgacacaacacccctgcccccttccaggatgccgaacagccttccctgctcattgctgtcccccagacaccgcaccgccttgataagcgcggaccagtatgtaagcacggtggttacgccgaaggccgcaaatatcagcctcattgtgccgtagcttgggaaggtggaaaacagaagtcccaccaggcccgtggatataaaggaaatggtcagcagctttcttggggacacacggtctgcaatccacccgccgaagaaataacatatcatggaaatggttgcgtaggatgtggagagcgccccgaattcctcattgcttagattaagggcctccaccagcggaatataaaatgtattccggatatagggaagctggaaaatgacaccagtaccgcagcagagcaccaacagggacgtccactttttcacatcaaattttttcttactgttcactgtaaaaccccctttgtacagtctttacttgttttttgttgatacgcgtctcaacttgtctcccattatagcggataaaaatcaaactgctgtcttcttgttcaaaagacaacagttttgttacagctttgatacaatccgccaaaattccttgttatcttataatatttgacgcctcgtacatccacagagtgtccggtttaatctggtctgtctggtccggcgactccagacggaggtagtccccagccgggaaccccatggtgaccgtggtatatactccctctgcgctctcgtatttcagcgaaccgtgatgatgctgcatcaccgacttgcagatggccagtcccatgccgaaaccgtcctccccctggctgtgggccttatctcccttataaaacggctggtctatcttatccagaatatcggccgggattccgattccatggtccgttacccggataaatgccagggcgttttcttccccggccgccctgatttcaatcagtcccccttcatgggaagccttaattgcattgtccagcacgttttccatcatggtaataagcagctccctgtccccatagcagaatatgccctccgggatgtccgtggtaaaacggatttctttctggttggctttcatccgtactgccatcagcgatgtctccagcatttttttcacatcctgccgttcaatattcagcagtcccggctgtatgcgtgacagcttaatcattttccgggtaatggaattcagccttttgccttcctccaggatatagtccaatgcctgttcctgaagctctttatcacagtcgtggttttttagcagttccgcatagcctatgatggatgtcagcggcgtcttgatttcgtgggtcagattgcccacaatctgtttgtaatcatcaatgtttctgttgatggcagcagacatgagattgaaattatgggacagctcgctgatttcatcctctccctccacgggcagcttaaggggaatggattcctgagccatgagttttgccgcctcattcagccgttcaatgggagaggtaatcctctttgttatcagaaacataatcatggctgtaataaaagcctgaagcaggcacagggcaaagaaaatattcagctgcatgtcgcaggatttatatatatcagataaatccttaatcatcactaccttatacatcatattgtcatatggaaattcagactccacgtacagatacctggaatcccctatgtccttcatataagtgggcgtataggctgcctgcccctccacaaaggtgtagcggggagccggggggaacttttcaaagctgtcatatgtaagcctctccccggcccatacctgcaggtaccgtccctctcccgccagctcctccctgaaaccgtccatgaaccctgacaagccttttccggcctctgactcctgaaaaaaattctcaattttccccgcgtatacggactggtaatattccgtcctctccatctctccttccagcgtaaagtgcagtcctgtcaccacaagataaaatccgcagaaaaagaaaatggccacgctggctatgaatgcgcccaggaatattttctgccaaagtttcatctgtcatcactccccttaagcagataccccaccttggtaacagtctgtatgatgccttcccaatccagctttttcctcagcctctggatgtggatatccacagtcctggtttcccccacatagttatatccccatacatcggagaggatttcctttctggtcagcaccttgtcgcagttggagcacagataatacagcaggtcaaactccttgggagtcagctccatttcctttccgtccttaagcacacggtgcaggtcagggtccacactgatgttcctgacattgagggacacgggacggcgcctgcaccggcgcagcaccgctcccactctggctaaaaggtccatactgtcaaatggctttgttatgtaatcatcggctcccacctggaggcactggaccttgctgctcaaatcatccagggcagtcaccacgataatgggcatccggaaatcctttaccctggccaggatatcaaccccgcttacctttggcagcatcaaatccagaatcagcaggtcaaagggttctgcctccagaatctccagtgcaaactccccgtcataaacctggctggtatcgtatccggcaaaggacaggtgggtcttaatcaggttggatatggccttattatcttctgcaatcagtatccggtacatgcttctcatccccctatcttacatttcgtcatttgtattctggctgcacttatcgtatttcccgggattgcgcattatcttaatcagtgctgcgcaggaggcaatctgcaggaacatggagggaaaaccgcctatgctggcaagagtctttgcgcctcccactcctgtgaacacagccatgacagccgccataatgccgattatcaggccccagagtatcttaaggccaccggggcctccatctcctcctcagacattccgctggtgcacacagaagcaattgcattggtattggaatcagcggcagtgacaaaggatatgaaggtggcaagcacaaacacaggaatacacagctgacgcaggggaagcacctcgaaaagcttatatacaatggattctgccccggatgtctccagcagcggaatcaggctctcctgcatgtgcatatggatggcggtgccgccgaatatggaaacccaaatcatggaaaaaacagtgggcacaaacaggtttatgataatacagtctcttattttatatcctctggccagtttccccaggaacaaggctgtaaccggcgcccaggccaggtaactggcccagtatcccaccttcatattccccaggctggaccaggagctgttgccaagattcatggaatccgtaaacagattgcgcatgaaaaaggaatccatcagctctcccactgattccgtaccaaaattcaggataaattttgtgggaccaaacaggaaaatgaacagaatcagaaacgaaaatatgtatacattaaagctggaaagccacttaatccccttcataatgccggacgacgccgatatggtatagaccagtataatggccgacataaccattatcagcataatgctgttggtgggtatgcctgttatgttggatacgcctcctgccacggaaaaagctcctgtggacagggaaccggacatgccggcgcagagtatgaagatacagagagcgtcaatgccgtccgccagtcttccctttgtggcccgttcccccagtaacggagagatgcaggaccccaatgaaaatggtttcttcatattgtaataggtaaatgcaaacacggttgccgccagggcatagattgcataaggtgtgattccccagtgcagatacatctgggccatggcaaaaacagctgcctggggcgagtttggctcaatatcaaaaaagggcgacgggtcgctcatgagataaagcggctctgccgctgcccagaacatcaggcctgccgcaatggtggtacacaggctgatagcaaaccagttgaatttgcccagtattggtttggcgtcttttccgccaataaccgtgttgccgaatttagaaaagcaggcataaaaacaaactcccactgccgccagtccataaccggaaaacagccatttaaaattgccccaaatccaatcctttaccccgttgaccaccttcaaaaaggcatcctgggacacaaaccccagtatcaataccattaacagtaccaaaaacggcggccagaatacccagccccttagcctgctctgcctttttccccctgacatgttccccatttaacagtacctcctcatcttttgtcccgtctcctttactgccggagacgtttaacctgtggttgtatcatttaacctgtaaactaaagtaattaggctcattatatcatttgtacacggaacccagaaacaattttacaactctgatacaaaaaccaggcagattatccgccaaaaaaaggctgcgtttccaccggccaatgccggtgaaaccacaacctttaatcatagaccggtaccttaaaaccggctgcctattcactttgtttatccaatcccagatatttcctcaccccggccgcaaacagctgctccctttttacggccgtatccgggtacacctcagcctcctccttccacacatccattacaagccccggccgcgcccccatcatactgcaaagttcttcagccgtgtaaaccgcatcctcacacagacccagcatgtccatgatacggtggtccagcatctcattatagctgttcttggagctgattccttttatgtgcgaaatacagtccgtgcatttccggtcactgcccaggaaccggcagggcctgcatatgtcatctgccccggctgtaacttttatctgctgctggcggttctctattatcccgtttgccgccctgtaaaaatcatggccgtaatccgtatccggtacaaacacctggattccgcctccaagcagcttgataatatccataaaatgatggggtttaataaccattttaatatctcctgttcatccggaatctttctacagccccagatactcctcaaacagattgcacaccctgaccgcatccgcctcatgttccatctcgcagaatatgcggagcaaaggttctgtgcctgaaaacctggcgattacccagcctccgttcttaaaatataccttgcatccgtcaatataggatacatggtctgtctcaaagggcagctccggcagtttcttttcctccataaggatgtgatggatacgctccttttcctccggcgtgaacctgtaatcacgctccgccatgtggatggccccgtactcctttctgatatccgctgcaatctccgacagcttcttgccgctgacagctatcatctccaccagaagggtggctgcatagatgccgtctttaccgtgtatatggccttttaccgtcagaccacctgaggactcaccgcctataatggcgtctttctcctgcattttagcggatatatgcttgaatcccacgggcacctcgtagcatttctgtccaaagctctcagccaccttatccagcacatgggtggtggccaggttgcgcacggcaggtcccctccaccccttgtatttcagcagatagtagtagagcatgaccagtatgtcgtttgcatggagataatgcccctggtcatcaatcactcccagcctatccgcatccccgtccgttgcaataccgatatcacaatagcggtccagcacataattctgcagattccgcagggtccgctccgtgggcgcgggcatctttccgccaaagagggtatcgtgcctggagttaatggtttctatggtgcaccttgcaatggaaagaatggtgctcagggccgtcaggctcacaccgtacatggggtcaatggcaatacgcaaatcccgttccttgatggcatccatgttaatcacggaaatgatattatccaggtactcgttcatgggattaatttcccggaccatgccctgccttacaagctccagatatgagggcgggggcatctgcccgttttcctcctcatttggcacgtagagctcctccgcctgttccaggtaatactcaatttccgaagtctgtttctcatccgcatcccggcctccgtaggtaaacaccttgataccgttatagatggccggattatggctggcagtcaccatcatgccgtagctcagttcatgcttcatcacatagaacattaccaggggggtgggcgagctgcggtttacaaaccacacacggattccctgattcccaaatatctcgcaggaccatatgatggcctcctttgaaagaaaccgccggtcataccccatgacaatgccctggccctccgctccctctgccttcatcttaaggcatatggccaatgccagcttctgtatgttctcttttgtaaattcttctccaataatggctctccagccgcctgtaccgaactttaccatatgttttctcctaacactacacgattgacacctttcctttgctcaccttcaggaagataagcagcatgaccactgtgctcacagtcagtattgatgccagggctgccgctgtgccgtaactgttgcgcaccacctctgtatagatggccacggaaatggtacttgtcttgccgccgtagagcatgacgctggatgacagctcattgatacaggtaatccagctgagaatggctccggacaggacgccgggcgccataagccttgctgtcaccttgccgaaggtcttcataggagacacgcccaggctgatggacgcctcctccacactcggatccatctgctgcaggaaggcgcttcctgaccggaccgtgtagggcagtttcctgaccacaaaagctataatgataatcagggccgtacctgtcaggatgacaggaggcttattgaatgcaacgattaagctgataccaagcactgctccgggaatgacaaaggggaacatgatgattaaatccatcagctgcccggccagacccttctgccggaccacgatataggaaatcagcatacccagcgctatgataaacacaatggcaatggtggagaatacaaaggtattcctgatgttggtccacaggcggttgaaaatggtaatgtagctgccaaggctgaatcccttctggaagcctgtgaaatcacacttgataaagctggtgataagcaccacaatctggggcaggattcccacaaaagtaaccagcatcacagggaaggtcaccaggaaacgcttcaatccgtgcagcacctcttccttgggaggacgcatggctgtcatgacataattctttctggatacataatacttctgcaccagcagaacggttgtggaacagattacaatgataacagacagggcactggccaggtgggcgttgcccccaatctcactcatgtattcattgtataccagaaccggaagcaccatatatccctcgccaatcagcatgggcgttccaaaatcagccaggctggtcataaacaccatgatggctcctgctgcgatggacggaagcaccactggcagggtaatggtccacagcctgcgcagcttattgctgcccagattttccgcggcctcctccaggcttgaatcaatgcttcccatggcccctgaggtatacaggtacacataggggaataatttaaaggtaaatacgatgataatgccaattttgccgtaaatgctgggcagatggataccgatatttgcaaacatgctggtgatgaaaccggaacgcccgaacagggtaatccagctgtaagccccgataaaaggaggactcataaggctcatgatgatgaaaatatggatgaacctctttcccactatgttatatctggacatgacataggctatgggcacgcctaccaccagggtggtcagtgtagttacaacggacacgaacaggcttcgtccgagagccgtgtagtagtacttcttagtaaagaaccggatatagttctccagggtaaagccagctgcattttttgaaaagaagcttcgtgttatcagggtacagaagggataaaacaggaaaatcagcatgaatcccactaccagcaccttgacccagaaccagaaatccagctttttccgcgattttaccatgaaatcacctcctgggtctgggcatcgtacacgcctacagcattgatatcaaagtttaccttcaccctctgcccgtcaggacgcagctcacgcacatcctttgtgtactcgttaagctgcacggtctggccgttatccagttcaatttcatattcaatgaaatcccccaggaaggtggatatgacaatttttcccggcagtccttccttctcgtcaaagaacagctgctccggcctggctgaaataatcccctttcccttaaagggggccttaagcctgcatgtgatggtgcactcacccttgatgtccaggatagctgcctccggatgtttgccgtccacatcacattccacaaaattggacacgccgatgaatcctgccacaaaggtgttctgaggcttcttgtatatatcctcaggggaccccacctgcatcacgtccccctctttgataactgctatgcggtctgagatggccagggcctcctcctggtcatgggtcacatagatggtggtgattcccagccggcgctggagcttcttgataaccgtcctcatctgtaccctgagctttgcgtccaggttggacaggggctcatccatcagcagtacgccgggctctatgacaaaggcccttgcaagggccaccctctgctgctgtcctcctgacagctcattgggctttctgtcctttaacttcttaatctgaaccaggtcaagggcctcatccaccttgcctggaatctggtcctttggatacttctttgcctttaacccgtaggccacattctccgccacagtcagatgggggaagatggcgtagttctggaacaccatgccgatatctctcttatgggcttccagattgttgatgaccttgtcgtcgaagcagatttccccgccatccacgctgttaaaccctgctatcatcctgagcaaggtggtcttgccgcatccggagggccccaacagtgtaaaaaattcgccctgttttatctccagattcactccttttaacgctgtaaaatcaccgtacctcttaacggcgtcctttatgataactgcatggctcataccagtctcctccaatcataccctttacgtgaaagactgtcccgcccttccgggtccggacagccttttcaccatgttcctctgacagtttaacgtttcctgattacttaatacctactgcttatatatacacaaatactccctcggatttagtctaccataatgtcattgaagtgctcaatgatggcttccttctcattggctgcccagtcaaagtcataatcaaccagcgggatatcttccagtttagccatgccctcgccaacttccatgtcgcttcttacaggacgtcgtccccagtttccgctctgctctgtctggcactctttggaagtaacaaaatcaatgaacagctttgcattttcctcattggggcatcccttaaccagggcaacgccgtcaggaacagcactggttccatccttcggatatacaaatcctaccgacgggtcatccttatactgtacagctgccttctccagggtcagacctacatagaactcgccgtctgccaccatcttatggcacttgcctgaagagtcaacaatctttccgtccaggttgtcatataatttcttgatgaaatcccatccgtcttccttgccgccatggcccagaatcatggtacacagctgtgtataagcagaaccggacttggatggcagacaatatgcaatcttgcccttccactcaggctttgtcaggtcttcccatgtctccggaatggtcagtccgtccttctcaatcaggtccttgttatagaaaataaccattggcaatgggctctcgccaatccacagcccatccgggtccttgtaagcagcgcctatgaattcatcgttagcacatacataaggttcaaaatattccttaaatgctgccagggagtcagcgccgccgccccacaatacgtctgcaatggggttggctgtctcagccgcaatacggttgcacagctcgccggtacctgctgccactacctcaaccttaacattgggatacttctccatgaacaggttaacgcctgcattcagcggatctgcatcatggggtgaatataccaccacggttcccttataatcctcaggagccttctcacctgcggccgctgcctctgccttaggctcttctgccttctcctccgccttagtctctgccggtgcttctgtggcagcaggagctgccgtggtatcggccggcttatcgccgccgccgcatgccgccaggcttaaaaccatcattgctgccagtgaagctgttaaaaaccgttttttcataatacacctctccttttatatcatattttcagttcacgtaatcattgggagtttttacctccgatagtcatattatatgactttattgtgcgtttttccatttgttattcttacatttcttttgttattctgaactattgcatagttttaatggctttttttatatttatatatgcatattatccactctccaggagcccttttaccgaaccggcataaacatctgtataaatatgggcaaaaaaagccgcggcattttcaatctgccacggcattctctgtttcaaacacatatttagttaataccagcgcctgttccgcctgcctgttcctgttccggcctatttcctatatccgcatttcggacacacgccgttttcatctaatgcaataccgcataacggacagcggtccatggtcctctggggcttaaattcctcggacgctgcatttacaccgctggtaaaggttattttcacgatgtttaacttgtccttcagcaagtcatagacaattttaatcatgccctcaaccgtcattgtctcctttgttacaaccagacggcattccggatatgctgtggcaagctctgttttaaaggccgggcctttcattgtattgttaggagccccgtccttgataccctgggcctcatatacccccaggagcgccggaagcaatgggtcgtcttcccgtaaaatcgtagcatggtcaaagtttttcagaacctcccatgctgttttctgaatctcgttacaggggaataccatattgacacctgcattaaccgtatcctctacctccaatgtcaatatgcctgtgtgtccgtgcagatactgtgcttcacccttaaaaccataaaacctgtgtgcatactgtaaatccaacctggtgatacttctcatataaaacctccttttcttctgtatttacgggtttctaaaaataataactattcttattatcattatagtcaatatacccgcagaagtcaaggaaaatccatctgtaatttcaactatcttaacatgcaaatccttactcttcctcagccaattcccttactgcccggattccggtatcaacctcttcctctgtgttaaagtaagaaaagctgaaccgcaccattccctgttccacggttttaaaggattcatgcatcagaggcgcacagtgggcgcccggccgggtggagattccgtaggtgacagccagttcgtcgctgacctccgaggaatcgtaatttccgatattcagggccacgatggctgcccgctcatccgaagagaaatcaccgtacacccgtacacccggtatccccgacactccctcataaaaccggcgcatcagttccgcctctctccggtggatgttttccactcccgtctcctttatgaagccaagggcggcgtgaagacctgctattccatggccgttcagcgtacctgcctccagggcagtgggcatgtcctggggatgttctttcagataggtgtggacgccgcttccccctgccttaaggggttttatacggatgccgtcacccacgcagattccgcctgttccctgggggcccagaagccccttatggccggtaaagcacagcacatctatatgcatccgcttcatgtcaatgggaaggactcccgctgtctgggacgcatccaccaccaggcggattccatgtctgcggcacagcccgccaatgcgttccaaatccatccggttgcccgtcaggttggaagcatgggtacatacaactgcctttgtctcaggccgtatgctttcctccagccggtcataacacagaactcccttctcatcgcagggcagaatcgtcaggctgactccccgcttttccatcagataaagaggacggagcacggaattatgctccagcaccgtggtaatcacatggtccccttctgagaacaggccctggatgaccgtgttcaggctttccgtggaattactggtaaatgcaacctgcaggggattgcccaggtgaaacaattcagaaatcctctccctggtttcataaatcatcctggacgcatccagggaagcctcatgggcccctctgccggaattgccaaaattcctcatggcatccgcaaccgcgtctataacgcagtccggtttcctcatggtagtagctgcattgtcaaaataaatcataatagcgcctccctttcccaccttatcaatcgggaaattccaatcacaatccggtcccgcccaacattcatacacggggcgggacatctgttggcatacaccctgatatcagtacatgagctgaaccatttcctcatgctccacgcccttttccttcataaaccctgccatctcttcttccatgtcaggttcgcagcaccaggcaaggccgcagcccgcggatatttccctgggcaccggtatcatccttcctgacttccggttctccttacaaagcttttccatggcaatggcttcagccgtggtatgaaatgtaataattaatttcggttctttttttctcatcccatcaatcctttcgtatctaaaaatatgctgcagcagactgtcaccaggctgtcaaacagcctgacaccttccactgcagcatccggtttcagaagccctggttcagacacgctgtgactccgggacatctgttttattcaatcactatttcaaattcagaccctttttcggttactgtagccgtctttccctggctctttgcgtacttttcaacattcatcctggtatgaggttcactgaccagcaccctgactgtctctcccttgtgtttcttaagggccgccgctgtcagcaatacaggctccggacaggatagtcctcttgcatctacttcgtacatatctcctacctcctatttcccttcctctgactttggcacaaatccaatgatgaacaggatgacaatacatccaatcaccgcagccttgccggccacggcaaggccgcctggcgccgccggggtatctgcggtggctgccgctgccgcggatgcagccagcccgaagttgtggcagaaagcagctcccacaagaagcccaaggaatgtaaccgcagagtcagatgagccctgaccggctaagaccagctggcgcagcgggcatccgcctgccaggaccgctgcaaaaccaacagcgtaaagtcccaggatattccagatatgttgtgaatgtgctaccggctgtcctgcaaaggaaagcttgaagccgcctgtggccaggttaaacaccagcatgacagcaaacagtccgccgatgacagtaatcaaatcaaaattcttcattaaaatgacgtcgcggatactgcctgcaaaacaggttctgcatttctgtgctatggcgccaaacaacagggccacaaccagagcaagaagcgctggtgcatgcatgctgccaggacctttttcactgaatgcaaataatgtggtggtcaggctcagtacaaacaatatcaccagggcaaccgggagcactgccccgtttatctttccggtttcatgagcccttcccagtgaaaagccctgctttaaggcgattgtacctgtaaatacaccggccgcaaatccgatgaatcctacatatgcatttaaatcaccggctgacatgcggattaccatgcgcagcgggcatcccaggaatgccagggagccaatcatcatgatgacgcccaggataaaacgcagcatgggagacgacccggctgtggaacggtattccctggttgccagtgcaatcaggaaggagccgcagacaaagcccacgatttcaggcctgaaatactgcacaacggctgccgtgtgaagcttcatggccccggcggaatccctgatgaagcaggccacgcagatagccatgttctttgggtttccaaagtaagcgagaatacatgccagtattcccagcgccactccggacaggagcagtgtctttttagaacttgtcagattcataatcatatccccttttcttttggtaaaatcaactgaaaatcattcgtaaatcaattcatgttttacctatatttccttaatcatcttaccaaaatggaaggggcaaatccaattcaaaaaaacatggaaccgctttttaatatagactttttctatacaaaacactattcccgcctgattcatacataacccgctacataaaccgcccgatatcctgctgccagttcctgtccctgtattcaatcacaaggtcccggaatgcctccgcaatcggagacaggcgaatgttcttgcagtataccatgtaaaaggtccgtttcttctccaggccgtctatctttaaatatttaatccggtggctttcttccttttcaccggcagccatcctggagagaatggatattcccaagcctccggccactgcctgcttaatggcctcagtgctgttcatccgggcaatcacatccacatttttaaacacaggcacaccgtggatttccgccttttccatctcctgctttgtgcctgagccttcctcgcgcagaatgaatgtctcatgttcaaagtcctggaagctcaccgtacttccctttttccaccgtgcaaacttttccgtgtccggcacaatcagcaccagctcatccatgaaaaccggctcatacaccagactgttatgcatcttatagcccgtgagtccaatctcacccttctggctcataacattgtcaatcaccgtcttgctgtccgactggtccacataaaaccgtattttcgggcatttggcgtgaaactcccctatgagccttggaagataatactgtcccggaatactggacgcatatacatccagaacaccatccattgcctcgcactgggtctgcacggttgccagtgcctgggaccgggtatggagcatgtcgatggcatagggataaaacagctcgccctgctttgtcagggttatctcccttcctgtacggttcacaagggttgttcccagctcattttccaggttattgatatgagcgctgatggttggctgggtcaggaaggtggcatctgctgcttttgaaaaacttttgtactttaccgcatttacgaatgcttctaattgtctgaattccatagccgcctaccttgtcttctggacaagaatacgcacatcgtcctgtttctttgttatcttctgctggtcgcagtactccaggaacagaacggcatactttctggaggttcccagcaaatccctgtaatcacccagggaaatggtaggatggctctcaaagtatcccctaagaagtcccatggctttgtcccagttgtccttatgaatcagggcgccgggatttatcttgaccaatgtgcctttcttcaccaaatcattcgcaatctgtttggccatctttttgtccttgaatttattgattacatcgtccgtggccggtatctcatatcccgccttcaggtatgtctcctctatctcctttaacatccccttaagctcatgggaatattcagcattaaatccagcagctgcaatggcgcttgccatggtaaccgtgatgctgcgctttatcatctcatttaagaggacgtctgctttcctggactcccgaatcttaaaattatccaatatacggctcttaaattcttccttctccataccatcggaaataggattctccttatggaactgattcagaagctcggtaccaaactgtgtaatttcattccagtaatccttatggataaagcttccatcgctgagacggatggccctctttcccttgaccaggacctccagctgctcctctgtctcctggttggtccagttcagcttggtagccagtatctttggaacagggaagtaccggctctcctctttaagctccagctccagtacctccaaatcagtgcccagctccttaatatgaaggctgtcaatgacctcatcgtggttcctcttatgctttaaggcctctgcctccagcacaatgcctccgccgaaggtaatggtgggcgaatagaaacggatgatgaacctgtcattcctccttacggccacaggctcgtcgaaacggaactgcacataggcctcctcgcccgcggacagcacgtccttgtcaagcaggactgccttgcatatggcctgggccgatccatagttgatgtggaccctgtccccgtttctcagttccctgtccgtggatgaaaacagctgcaccttagcatctatgaactggcttttcagcagggaatcctgggcagccagaacctctcccctgttaatctcatcctttttaatgttcaccaggttcagggctgttctctgccccgcataggccatgtccaccttgtggccatgggtctgtatctccctgattttaactgttttttcagtgggatacaattctacctcctgtcctacctggcagcagccctccaaaagggtgccggtaacaaccgtaccaaatccttccatggtaaatacacggtctatgggaaggcggaacagttccttttcctggcgcctggcgccagccgcccttaccttatccactatcatctgctttaactcattgatatttttgccggtataagcagatacctggatgcggtcggccttttccataaaggtccccttgaccaggttgtccacatcgtcatttaccagctcggcccagtcctcatccaccaggtcggccttggtaaacaccacaatgccctgcttgatatggagcatcttcagaatctcaaagtgctccacggtctggggcataacgccctcatccagggcaacgaccagaagcaccaggtctatgccgccaatacctgccagcatgttcttcacgaacttctcatggcccggaacatcgataataccaatatggattccggcatcattgggcaggttggcgaatcccagctctatggtgattccccttttctgctcctccttcagtctgtccgtatccgtccctgtaagagcctttatgagacatgtcttgccgtggtccacatgaccggctgttcctactatcacattttgcatattatcacccctcaacctgtctgctgtccattgccaaaaatgctgctacaatatattcaaactcatcttccctgatggtcctcacatccagatatacctggttatgggtaatcctgacaataatcggaatctcttccttgcggagaagacgctcaatcttctccggcgtcagcgctctgccctgtatggccaccgcatatccgtccaggagcacggttggcgcggagccgcctcccacctggtccttgcacgcctctacctccacggtaaagttatgggttgccccgcggatggcttcggccaggcgctctgccttgtccttaagctcttttgccggcgtggtaatcatgttcagcacagggatggtttttctggcctggcggatatccgaatactcaaagaaggtggcctccatagctgccagcgtcatcttgtccacccggaatgcccttgccagggggtgggccttcattttatcaatgtactctttctttcctgcaatgataccgccctggggtccgcctaacagcttgtccccgctgaacagaatcacgtctatgccggtctttaaggcatccagaaccgtgggctcgtccaccccatactctgtcaggtctgccataagaccgcttcccatatcgtagataaccggaagatttaattttttacccagctccaccatctcaggaagttccacctcctgggtgaatcccagtatcctgtagttacttgtgtgtaccttcatcagggcgccggtctcaccttcgtgataagcgttcagataatccgatggctttgtcttgttggtggttcccacatccatcagcttggcgccgctctgttccatgatttccggcacccggaaggaaccgcctatttccaccagctctcccctggatacaatgacttccttgtcctttgccagagcagagaggcagagcatggttgccgccgcattgttgttgaccaccatggctgcttccgcgcccgtaatcttggtcagaattttctccacatggtcatggcgggaacctctggacccccgctttacatcatattccaggtttgtatagttcctggccacgtccatgatgctctcgcaggccttgtccgacagatttgcccttcccagattggtgtgaagcaccactcctgttgcatttatgacccgacgcaggctctttttcttcttgcctgtgatgcgcgccacaatttctgtcatcagtgtttcctttgtccccacctgattccgtttgccttccaggatgtcttttctcagctcctcaatgacttccctcactgagtcaacaatcactgacctgggcgtactttccgtaaaaaaaaagagacgctcatcctgcagcacctcgtctattttcggaatctttcggagtaactctcttctatcttccatcatatattacctccactacagatatggtttaaacggaggaggtgggaatcgaacccacccagagggctcttaaccccccacaacggttttgaagaccgcgaggcacaccagcaacctatctacctccatatcttttggatagcatttaactttaatatactatcatgtattcagttgtctgtcaatccataactttctaaatgttatcgcgaaaactttatattatattccgcgccgcggaatttctccgcggacacggaacatataacttatgaatgaatggctttcagtatggtatcaggccagaagggcctgaccagcatgtacttagctgacgtatccggcggccttcagaatctcatgggccttatccttgttggcatcggacatcagtacgatgggtcctgtacagcccatgccgctctccgcatagatgccggccttccacagtgccttaacagcatcctccaggtccataacctcgatacccggaatctgtgaagtaaccacttccttaggaggcatcttcacttcctcggctgctgcgccagcatccttcttgcctgcagacttcagctcgttgatgatatccttaagtccggccttgttagccttctcaaattcttcatcagcaaccttcttccagtcatggcggaccaggttggtggcgaactccatggctcctgcaataacaggcgcgccggaagcacgtgatacaatcatgatgagacggtcataaccctcaccaataccagggccgtaaccaaatccaagggactcgtaattaccgcctgtggtgtaggaggagaataccttcatcatcaggttgcctgtaagtgaatccataaccatgatatcaggcgttccgcctaacaggtcgtttcctctcatgacaatgccgccgtcagcccttacggactctgcgaaatgaatgtcatagccgttctcagccagcttgagcagagccttctctgtctggcgtgcgccgtcaatattagcaatgcccacggttggattctccacgccgtcagcctttgccgcaataattccatagattgcattctttaccatgccgctgatacggtctgtgtcggacgtacctgtggtagttgcgatatacattggttttcccttgcccggggtgataacctttccgactgtggacacaccgatggggaatggatagtgcatggtaacggcgccgtcaatctcgccggaatccagcatctcttccattttcttatgaaggtcttccccctcgataaggacagccttaagtcccttcatctcggcaatcttcatggcttcttcgatattatcctggccatgttcgctgccttctgaggcgaagccgataaccggctttttgccatattgtcctgtttcaagagcatcggccacctcaagaaaagtattagcaatcatagcttttattttcttatcagacataacatatttcctttctctcggtgaaaattattcctcttcgcccatcagaccctcagcaaacgctctcatggcctggccaatcatagcctttaccttgctctcatccacgccgccgctctcttctgaagcagaaccgtcgttggcctgaaccacgaaggatacgccgtcaaacagattggtcattcttccaaggaataagcttcccttaccgataatcatggcgcgctttgtctcgcctgccaggatttcatctctcagaagtcccaggtaaggaacgcctgaaggaatatgtccctgggtgggagcccagcctgtcataccatgttccttaacgaaatccgcaatctcattgcgctgtaattcgcctctcttaacgcccagggcagcaatcatcttgtagtttgcttccgggacatcgcctgcgcctgccggcttggtgatatccgggttctgcatctcaggagagtacttgtcgatatccacaatctttaaaccagcctcatccagaggattggttaccagggaggagataacgttctgaggagcggaacctgttccaacggtgtggcgtccaacgatatcagtcctaatctgcgggcttacaccgtcgtcagcgcttactaatacggagaagccagcgatagcgtcttccagaatcggaaggcccttcttcacatggtctttgccgttcatgcctaatttagcggtacagccgccggctgtaaccacaacgttcttaaatgtgccggattttaccagggcagctgcgtgaagcattgcatgagctggtcctgcacagaagcctcttacgtcagatccggttgcgttaacaaatcctgcaacctcagctgcagcctttgcaaagttgccgccgcctctctggttcatatcgccgcatgcttcctcgcagcagtcaactacataatctatatcagccggattaactcctgccttttttaccaagttaagtaaggataatacgttagaagcctttgtaaccaggttctctaacataacgtgtgcggataagtttacatccacatcatgagctctcttaacagcgccaaccagtacattgttatagtacagaggctctgcatgctcgtcatttaccagggcagcgatttcttcttctgttgtctcgctgttcttatcaagaaccgctacatgctcgtctgtaaacatgtgatgagcagacagcttagccttaacatcagctgcaaatcccttttccagtttaaccaaatcaaatacgtcacaaatctgaatcagaccgtaaaattcatcttccggcatgatttcgccgtacttaccttctttgctggctccctccatcaatttatcataccaggggaatccaacctcagccatcttctgtggcttttcattgccaatatatacctggttcggcatatagttaacggcatcctcaaaactcctcaaatgacttggaagttccttcaaatattctgactcaggattaacaatcatctctgttgtctgtgttgtaccattgtgaataaccatatcaggtgtaaccgccaatgtatagctggcaccctttaaaactgcataaccgttcattccttcacctcaccataatttatgacatctagtactgcgttgcgcaagtctcagtccgcggctgtctccgcgctgctgatgcggattacagctatgtaccatactggaacttgcgcaatgcagtactagcatagttgcacaataaaacccctttattgcacaaaacccccggagaccccatgaagagcctccaggggaattacattttaattataaatatttgcaatactgctctctgatggaagacatctccttagcgatgtcatcaacgtccataaccatctccatcatactaatctggtcgtcataaacgctgctgtcaacctcatctttgatttcgttctcacaaacatggaatacacttagtcccaactggactcctgctagaggacctgcaaaagtaggatcgcctgctgtaacggtttctgcagctaaaccagctgcctcaccctctgctgctccaagaacaactacaatgttctcagcgccgtactgctcagcgaaatctttaactctcttctgattttccagatccatagcaccagcggccgttcagacgaagcactcagttgaagaatatacaacttcggcgcctgcggtctttacgcattcttctatggctggtcccggaataccgtcacggtctccgatgatgatgacttttttgtctttcaaaattgccatatccgttttcctccttattttatttttggtatttaatttggctgccgggcgtatgcccggcgccataatatagacaaacgtcagtattgacggttgctagtaaaataatgcggttgtctgaggacaaattataagttagcctcaatcatagccttgatgttctcaacagttgcatcgtccttaacgcactcggcaaccttctcgccgcccttgtagatagcgataacaggaagaccaagaatcttctgtccgattgccagacgacgtgccttggtggtgtttaaagaggtgaatttaatcttatcgccgtaatcaccctccatagcatggatatgtggcataagagcctggcatggtacacatccatcaccgtagaagtcaaccagtactgtgccttcagccttcaatacttcttcttcaaaattgtccttggttaaatctaccattggtattaccttcctttctcaactatgaatcacttatttctgctctgccagccatctctcaacctgcatggaagcgattgctccgtcagcagcagcagtaacaacctgtcttaagctctttacacggatatcgccaactgcgtacacgccttccacactggtatgcatgtcttcgtcggtcttgatatatccgcggtccatctctaacttgccttcgaacagttcgcttcttgggttgtatccgatgaagccgaatacgccgaacaggccgtcgtcctcgtctgcatcgattcttgtaagctcacctgtcttaacattcttaacagtcatgccggaaaggatgccgtctccgtgaagctcttccacaactgtatcccacatgaagaacagcttaggattcttgaacgcgcgctcctgaatggattttgctgcacgcagttcatcacggcgatggatgacagtaacttttcttgcaaacttagtcaggtacatggcttcctcaacagcagaatcgccgccgccaaccacgaatacttccaaatcctcgaagaaggaagcatcgcaggttgcacagtaggaaacgcccttgcccatgaactcgccctcgcccttgcagccgattggccttgggaaagcgccggtagcgataatcagggtacgtgccttataagttccgttgctgccaaccagtgtctttaccgggccttcgatatcaacgctgacaatggtatcgctgacacgctcagcaccgaacttctcgacctgcttggtcattctttcaatcagggaaggaccgctctcgccgtctaccatctgtccgggataattctcaatctcgtccgtgatggcaatctgtccgccgtcttttcctttttcaatgagcagcgtatccagacgcgctcttcccgcatagattccggctgcaagtccgccaggacctgcacccagaatgatgacatcataaatcttgtccatcagaatatctccttacacatcaattgaatttcagggtttgcaaaatgccgcttcaaataatattttatcattaatctgacggaatgcaaactcttttttgtgcaattacaccattttcagaacgttgttgaatcataccatggtaactttaggcaccattggaaggaccggcaaagttcttttttacggatgtctagcttcggtttactcaaatacagtctgctctgtaaccggggtctccagtgctgtcagagccttagtaagtattctccttctgatatccttctcttcttccaaggtcagagccggatttccaagaggatgaggaatagcgatagcaggaacaatacggttagctcctactgtcagtgaaatcggaactacagttgcaatatgaactacagggattcctgctctttcaatttcttttaccatcgttgcaccgcaacgtgtacaggtacctcaggtagaggtcagaatgaccgcatctaccccgtcattcctcagctcctgtgcaaactctgcagcaaatctcttggagttagctacggatgtaccgttaccaactgtcgtatagaaatatctgtgcaggctgccgatttttccttctttttcaaattctcttaaaacgtcaacaggaaggactctgtctgaatcttcattggcatatactgggtcgtatccgccgtgagcagtctcatatgtagcttctgtcaggtccatgacaccatcgatgtcatatttgccgtacttggaagcactggaggactcgatgtggtccgggttgccctttggtacgataccgccggaggtaaccagagcgatttttgcatgagccatatccttaacagccggatttggttctaccctgtcgaagtcaggcattgggaactcggttgtgaattccttgccggccagcttcttaaccagcatctcaacagctctctgggagcctctcttgtcctcaaagaagttgacacggatgccgttcggcatatagccctcttccttggaggagccaagcttctcacccttggcaagcttaagtgccagaggagccatggtagcaacagcacttctcatgccggctgcgctgttctttgtctcaacgatatatacttttgtcttgtacatatcagcgcccgggttctctttgtacataccagtcaggaccggaaggtttaactcttccttaactgccagtgcaacggtaccgcaggcaacgccgtaacgtcctgcattgaatgccggtccgcagataactgcgtctggcttctggctgctaatcatatccagaatggtcttcttagcagcttcaacgttctcgttgaagtaagagtcgccgcagataacggtagctacgatttctgcctcttctccgaatgcctggttgaacgccataccagggcctacaatgccttctcttaattctggctggtaatcagccttttcctcgccgccgatgttagcgaagaactggttaatataatgaacaattcttaactttgacatcttatcctcctatctggcacttaatttattgaagcccatctcgtttgttgctcctgtgataacctgaagctcagcaacaatggaaccgtctttctgtaagcttccgtcgaatccgcctgcaatgatatcagcaacctcaggatagccgataactttgtccattgccggtaagttgatgaccatgtttgcgtttccgcctgtaacaacagcattagcgcttgcatctgcatctgccaaggactgggaagcgccgtcgcggcctgcgtactcatcggtgatgataacagtcttaacgccttttccttcaatcttcttgcagttcatgataaggtcagtatcagggttaccgaagccctcctgggaaacgatagcgccgtcaacgcctaagaactcgcaaagcttggatgtccagtcagaagaacgcatcttgtcagcaaggtatacgttctcgttggtgatgattacacctacaaagttcagggtctttccgtgctgttcaaataagtctgcaataacagggttattaaggtgatgataggttgtattcttgtcgcatgcagatacgcagttaccgcttaagatagcgccgtccattaattcggttgggtttaagatagttggtaaggactgcttcatatctacgccgtatacatatgtatcatgcatcaggccctggctctgaagcatcagtacgtaagctactcttggaagctcaggatatttctcaattccctcttttacggaacaggtctcatatactttaacttcatcaggctctacgtccttggccagcttgccgatgtaatcagcagccttcaggcctgcaaatctgacagccttctcatgagcatgctttgcaagtccgtcgattggctcgcatacaacaaccaggttgtttaactgggagaatggtgtgtacttagctccctcgccgcacatatcgatgataccttcctggaagccgacaatcttacctgtggtaacaactgcggaaccctttaacacgttggtccttccgcttcccactgtctccaccttggaaataacgcctgggaataagtttccacctccgttgacttttacacgtggctcaatcacgtcctttactggcatgatacggacactctctcctggtcttgcaatctccagctcaacagacttcaggttttcatcttccaacaaaagtgccttcaactcttctgcattaacataaatagttccgttttccacttttgattccgatgcaaactgaatgtcgttaatctgaacgcaccccaactcaagtttcatctaatcactcctccttgtatattattttttttacagctccttcaatcaatgataaatccacgtccctgaagtcttccagtatattttccggccaatcaggagttcttctgtccttcatgaatttctcgcaggactgaatactgttctccatcaccatctcaaactggtaaaattcttctctttcaacctcagagtcggaaattatgattgtcttgtaaggaatctggttaggcttcaggctccctgccataggatgggtttccaggcgataacctttatgtatatagtttctcaccctgattaacacatcaatgtaggaaccattttccaggaagtccacttttaatttgtcctgatacttgtccctgcacttcacgttgtttgtaactacgatgtacatgatgtttcaccctttgaatctttcttatttattaggcataggattccattccacataataatagagcaattatcgtgccaactttttctaaagtgggatttttttttattttttaccttttaaccaatggaaattcattttttctattgcttttccgtcctttataggttttctatattgtctattttgtcattcttttaacttctgacttttttaaaatttctttttttcgtgaactatttttcttgatagtgaaataaatttcagttataatagggggtagggagggattctttttatttttggcatccatttttcccttcttttacaattttcatgttaattttttctcaattttatgcataattaataaaatttaaaaatctaaccacaggagacccgattatggacgaaaacgatatgaaaaaaaagttttttttcaacacaaaatcccctgcctaccggagggcattggaagactgtgaacgtgtggcagcatccaatgtaaacgtcctcctcatcggtgaatccggttccggcaaggatgtggctgcccagtacatccatgcctgcagccgccgttccgacatgccgctcatagcagtcaactgtaatgcctacacggagtcccttctggaggcagagctgttcggccatgagcagggcgcatttacaggcgccatcaaggggcgggccggaaagtttgagctggcggataaaggcaccctgttcttagacgaggtgggcgacatcaacctgaccacccaggtaaagctgctgcgggccattgagacaaagagaattgaacgaatcggcggcaacaacagcaaacagctggatttccggctcattacagccaccaaccgcgacctggtagccaaggtgcgcaacagcaccttccgggaggacttcttttaccgtatcagtaccattgtcatccgcatccccgccctcaaggaaaggaaggaggacctggtggacatgattcacttcttcctggaggaatcccagagagtgaatcaaatcagaatcgaccgcattgacgagaaagcctgggacttccttattaactatgattatccgggcaatatcagggaactgagaaaccatgtggacagaatggtggttctttccaagaaccatgtcattaccacggaaggcatcccgattctctataacctgaagacaacagatgatgacactccatccagctccttcacccaggccggcattgtgccctggcgcgaatttaaacggcgcagtgaaaaagagtatctgcagtgggtcctgaaccagatgggatggaacatatcagctaccgcctacaagctgggcatcagcgccaggcagctgtttaataagattaatgaatataatctggagaatccccagaccggaaggcctcagaagccggtgcacagtatctgaggccgcgatattacacaaaaacaaagtgctgtgaaagcaaaatacagttggctttcacagcatctcttctataaatctaacgtccttccccgcaaatcctcacaatctcctggatgatttccctgaggcaatcctccagcaccacattttcatactgctttgtaatgctgcactgctccagatggctggggctgaaatcctcctcatctgccagaaaacgcctgcacatctctttatacttgggcattgtctgctgctcctcccgctccagggcccgcctcagcctcagtccgtcctctacatggatatagattggtacaagggcttcctttccataataggaacgcatcttctcataagattccaatgtccccataatcagataatttcctgtttccaaatcaatctgcccatcgtccgctgtaaaatagctccatggaccgtaaaccgtgtcataggtccggcactcaatcaaaatcccatcctgcctgcactgttccagataagaacggtccacaaaaaaatactccactccgttttgttccccgtcccgtatgggtctggtggtatacatggtaacggtcttaagctccggcatcctgctgtgaagcttcttatatatggtatcctttcccgaggcactcttgcccataacataaaatatctttcccatgatttactccgtacttccttatctcattcagtctctctgttccgtccctttttctgtttcattcttctgatatcccgtcagtccttctcaactatgcggatggtcctgagggactggtccgcagggccctgcaccggtagccccttatccctgtattccagaatcacttccaggatgggcctgctaatccattcccccggagccacaatgggtatgccgggcggatagatataaacaaactccccggaaatacaccctgcgctgtcctccagaccaacggacttcatagttctgtccatggcctcacccatggacatggccgtgtcacaccgcatactgtatacactgcctctgtgcatatcctctccgcctgatttatcatccgttcccgtgacaggccctttgccgttttccctgcgggcatcccaaccgccggatgccagacagccgtcaatccgggtcaatgcatcccccaggcgctccaggccttgggcgctgtccatggctgttgtaatggctgtcacgtaatcagccccgcacatttccatctccagatgatattctctgcgcagaatgtggtccagccgggcgcctgtaaagccggtatcaccatcttcccctgaagccaggtgcgttcccctggttgaaaccacgacttttgagatatccaggtccctgattcctgcctgtcctatgattcctgtatccaccagacgcagatgcctcatctggcccagcctcgtccgcagcttgtgcagctgtctcccataggacgtcatatccatatgttccatctggaatatactgttctctatactggccatgagcacataggagggactgctgctctgtaccatgtggagataacggtcaatgcgctcccggtcagcatagcatccgccgtccggccggttgcacttaatatgaagcagggctgtctgggtcaggctgggaagggtcttgtgcacactctgaatcaccacatctgctcccaggtccagggcagacggcggaaacatggcgtcataccggaaatgggcgccatgggcttcatccacaatcagcggaagccctgccctgtggacgatttgggcaatggcctctatgtcggatacaattccgtcataggtggggcatacgatgaggacagcctgtgtgtccatataccgcttaagcatcctgtccacatcttctgccgtgattcctccctgtatccccaagccttctatctcctgtggataaacataggaggccttaagctgattcaggcagattccgtggtacacggatttatggcagttcctgctcaccaggattctcccgcctctgggtacggctccgcatacagcagccagaatcccgctggtacttccattaatcagataataggtctggtcagccccgtaaagggctgccgcccaatccatggagtctcttaagattccctccgggtggtgaaggttatcaaacccgtcaatctccgttatatccactgtgcagggattcacaaagcggtccatgggacccggcatacgcttatgtcccggcatgtggaagggatacatatctgaccctgcatatgcagccagccggtttataagaagctcttcctgtctcatcccaatgtcctctcacggctcctcaatatgagcctggtcatactgtcctttaactgtttccggttgcggaccaccagcattttatggggatacctggccatgatggactgatggctgtgggcttcatcccgcccatcccggagaatccatttcacgaagtcccagtccattttctcacggcagccctccgccatgctctccctggttttatccctgtactccaaataccgttttacagcctgccacaggcagattctccttgtataatccataaatacaatcaggtctgcttcctccagacggcgttcctggcagaatttcgcgtagttgccgtcaataatccagcctgtatcctgattctcatccagaaatgtctccgccatcctctttgcctcttccctgtcacgctctttccatccaggttcgaattgtattctgtccaaatacagaaccgggcagtcgtagagtctgcccagtttcttagccagtgtggatttgccagcaccgctgtatcccatgactgctattttcatattgtcaactccatatcatccgcatttttcttttcatagtatacatgaaaaaccattggattcatagagtgattctcagagttttctgcttatacctgtaccatgcatgaacctcctgcgccggtttccttgcagtcttaatggtttctgagatacgacctggctttcagaactgaaaaattacaggtccgaagtcccattggttctccgtcatcccatacctcatatcttcccgcataccaggacagcaggcgctcctttatctcagaatccgccattccctccagggcaggggcagcatccgtggaaagacgcataaaatcattctgctcctccctggcaatgttgtctctgtgggatacattataacgggctgttatatagtccggacgcatccacgctaacacaagatagaaggaagatactactgccaggcagaaccggaacaaaggaaaatcgtgattaaaaataagaattaccacccccgccatcagcacaaacagcatggccaggaaccacagcaccaggattctgaggaatgtcagctgatactgctgtacatacagcaccatcctgtacacggcagacgccagcatcacataggtacaaaggctgaccaacagcaaaaaaatatttaacagggcatgttcacgaaaatacttaaggcacataagcaccatcacaagattcaggacagccacaaagagcagctggaaaaatccctgtctggcatactgggaatacgtcattcccagaggcagacttccctttcccataaaaaggtacacaatctggatgacgcagaataccaggtaaacaatgcccaccatagccataaagctgaccgctgccacgggagaatgcctgcgtacatcggccattccgtcactgatgcttcccccataggcgctgcaaatcaggcagtacatggccagcgaccagaatatggtctgaagcgccgcaagaaacagggtgaccggattcagaaacctggagataacaaccaccagcatgttcctgaataccatgtccgcgcctgacaaaagcacgcacaggaatataactgccggtattgccgcgcaggcgcctgccagcagccggaatacattccggctccgcttatccttcagggactgtatatattcccctaaatgacggaacggataaaataccattcccactgcctgggccaggtacagaacaatggaagccatgtattttcctatgttccatttattatcctgatggcactggtgcaggatgaatatacaaaacagaagaatcagggccagccggttcatataatacccaactgtcacattccctgtaaaacaggtggaaagtccaatcagcagggatacagcagccagcagccgggaatccttcttaatggccactcccattttcctgaatatcaggaatgctgacccataggtggctgccacgaacaatgggactgtaatccccatgggattccgaaacaggcagaaactggcgcacacgccgtaaaaaatactgagaaggccgaaaaatccaaaatcccttcctattctctggagacgcttacccagcctttcctctgtccggtccccgctgccgcttacagctcccctgggtgtcacagccgtcaaatacatcttatcatccattctcactctctccttcctccggctcataacttaatatatcacccggctggcagtccagggctttgcagatagcctccagggtggaaaaccggattgcttttgctttattatttttcaggatagacaggtttgccatggtaatgtccacttccgcagacaattccttcagacccttttttctcctggccatcattacatccagattgattacaattcccatgtcattcctccctgtctagatagtcaggtcattttcctgcttgtaacggattgcctgttcgaataccagacagagcacgaaacagaaaagacctgctatcgagaaaacaataataatcactgccgtggccggggtaaatgccacaaacaaacgcagtaccgacagaatggctatgagaaagctgcattttcccattcgttttaaggacgctgcattttccatgacaaaggcgtcgtctgccagcacagtggcaaacatccgccgcagctccagcacaagcaaaagtgccagcacccctgaggccatgtatagcatgcactggaccacgtaataggtcctgaacgtctcaatatacatgcccacatagtgaaaaagaaccggaatcgccgctgttatagccatccccatataaaacatgatgtccagaagcccttttgtaaatcttaccaaacgcatattcatactaaaatccgcctttctgtattgcttatatgccccccggagggcttttaccttactcgaaatccttaattggaatataacaccgtttatattatttttcaatatatttttattgatattcgataaattaatattgatatataataacaattaagaagattgtaaggattacatgggggcgcagaagaataaaggggggacgcaggagcgcagaaaggcagggacgcagaaatcggttgacaccgcctatggttagaattataatagttagaattctaactatttggaaaggcggtccgtttatccatgaattttcattatctgttaatgtcaggccatgccatctatttaaaacagcttatggcccagctgcaccataccggcctgacatccggccagcccaaggtcctggactatctcatgggacatgatggagcaaaccagaaggagattgcagatgcctgtcacatagaggccgccaccctcacatccgtactcaatggaatggaagcaaaatcccttattgagcggagacgggcggatggcgaccggcgttccttttatatttatctgacggatattgggaaagagatgggacagaacgtaacagaggcattttccagactggaaaaagatacattccgggatatcccgcctgaaaaggtgcaggaatttatggaactgttccaggaattatatctaagaatgaaacggaatcttgatacagaagaacccgcaaagtaaacaaggaagctctccccaatatctttggcctgtctgccattaccatgggaatcagccttattatcatgttaaaaagtctgtctgccgtggtgctggcccttattgcgggtactgtcataggagaacttctgaacctggaggataacctgctaaaggggcttcaccggctggaggaacggcttcccctgacactggatgaccagcagatggatgtgttaatcagtatgataatcctgttctgcttcagcggaaccggggtattcggcgccatgctggctaattttaatgcctgcggggaaatcatcaccctggcagtgggtttaaaaattgcaggtatcaagcggaccaaggtcttaaatattcttccggccattgccatcattttcccgctgtcctgcctgctttaaaaaatatgttaaaatcagcagataagatgttgtcataacaacatacattttcggttttccatagtatacttccagcataacaacaattcactgttttgcttcaaggaggataaaggaatgattcgaagaattattaagataaatgaagacctgtgcaacggatgcggcgcatgtgctgcggcctgtcacgaaggagccatcggaatggtggatggaaaagcccggcttttaaaggatgattactgtgacggcctcggggactgtctgcccacctgccctacaggggccattacctttgaggaacgggaggcggctgcctatgacgaggcagctgtaaaagcccgcatggtcagggaagcaagggaaaaccctgtttccacagaaagcctttccacggaaaaaaccctttccatggagagccggctgacccagtggcctgtgcagattaaactggctcctgtccaggccccttattttaaggatgcccgccttttgatagctgctgactgcactgcctttgcttatggcaatttccacaatgattttatagccggacgcatcaccctgataggatgcccgaagctggatatggtggattactctgaaaaactgacggaaatcatccgtctcaatgatatcaaggatgtcaccattgtccgcatggaggttccatgctgcggcggtattgaaaatgccgcaaaacgcgcactccaggccagcgggaagtttataccgtggcaggttgtgaccgtcgggacggatggtactctgatacggtaaagctgcggccggccgtgaatcagctgcgtatccggcacagacttctttccttcaatacgcatacacgcttaaaggcgtttaagatacggatacacccatatcttaaacgcctttgccgtactcagtattgggcttatggaatcatttacctctgggtattctgaaacttctccagcattgccctcggcgtagccgtcctcctctcataccttggacactccaccccgtcaaaaccagccagatacttggcaatcttcttaagttcctccaaatcataacggctcataagggtaattgtctccataagaggcgaaccgcctccatgtacaccggccacacactgggcaccctcgaaggcgtcgcagagtttatcctgatgttcggtatcgccggattaatcggcccccgtgcggctgttaagctgaacgttgggggcgactactccagagccttcctcatgggctttgttatgtccgttgtatcccttgcagctacttttgttgtaaagaaaaaggtggccgtatcgctgaaacaggcctgacataaaaaatcacctgcccattcggttcttatgggcaggtgattttttgattatttaatgacctatttatctctcttttgtctcaatcatcttcttaatatctccgatgaaatcatccagtcctgcagcgcccaggtcgcccttatcgcggcttctcaccgtaattgcgccctctgccgcttccttttcacccagaaccagcatatagggaaccttttccagctgggcctgacgaatcttgtagcccaccttctcgtccttgtggtccagctctgtgcggataccggctgcctttaacttctcatataccccggttgcataatccatggacttctcggaaacaggaattaccttaacctgtacaggagccagccataccgggaactttcctgcaaaatgctcaatcagaataccgatgaaacgctcaatggagccaaagcatacacggtgaatcatgatgggacgcttcttggagccgtcctcagccgtatattccaggtcaaacctctgaggcatctggaaatccagctggatggtgccgcattgccatgtcctgcccagggaatccctcaggtggaaatctatcttggggccgtagaacgcgccgtcgccttcattgacaatataatcaagccccatatcctccagcgccttcttaaggccgtttgtagccatctcccaatcctcgtcagaccccatggaatcctccggcctggtggacagctccacaaaatactcaaagccaaactgtgtatacacttcattaatcagctttgttacacccttaatctggtcctcaatctggtcatccctcataaagatatgggcatcatcctgggtaaagcagcgcacgcgcatcagaccgtgaagctgtccgctcttctcatgacggtgaaccagtcccagctcgcccacctttaaaggcaggtcgcggtaagagtggggctggttcttataaaccagcattcctcccggacagttcatcggcttgacagcatagtcctcctcatcaattacagtggtatacatattgtccttgtaatggtcccaatggcctgaattctcccacagcttgcggctcaggataatgggagtggaaacctcctggtatccgtccctgtagtgaatctcacgccagtaatcaatcagggtattctttaatgtcattccttttggaaggaagaatgggaatccgggtccttcctctgcaaacatgaacaggcccagctccttgcccagcttcctgtggtcgcgcttctttgcctcttccatcatggtaagatagctctccaggtccgtcttgttggcaaaggcggttccgtatatcctggtcagcatcttattcttctcgctgcctctccagtaggcgcctgcaatgcttgtaagcttaaatgcctttacgccctttgtatacatgatatggggtcctgcgcacaggtccacaaactctccctgctggtaaaagctgattgtctcctcctccggcaggtcctcaataagctctaccttatagggctcacccttttcctccatgaacttaatggcctcagcccttggcagtacaaagggcttaaccggcagattttcctttacaatcctggtcatctccgcctctaacttttcaaggtcctcaggagtgaaacctccctccctgtcaaaatcatagtaaaaaccgtcatcaatggccggtccaatggccagctttgtgtctggatacaatctcttcactgcctgtgccagtacatgggatgctgtgtggcgtatggccctcaactcatcctctgcttcctgtacacttccgtccggtaaaatgattttcatacaaatctcctttctttacacgggcctttccggtcccatgtctttggtatcagcctgctgtgatgattccggctgctgtagttgattccggttgttccgccgaatccgtttcatactgaatatgtccgccgccggaatcctgtaaaaaacgggaaaataaaaacccctggacatattcatatgtccaagggtgcattcacacggttccaccttgattttcactcatttatcccttaacgcgggagtacggcgccatttcccatccgttttgtgctgtagcacctgtgcggacatccctgacgcggctcaggactggtcttcgtcagtctttggtatgcggcctttccaccaaccggcctgctctctggatacttcccactgactactgtttccctcattgcctttgctgcttattgctaatcttgattataacacctgcctctgatttgtcaagaccggctgcccaaagttgaactatttaatgtataccctcacccttgtaagtatctatcgataaaaattgtgaatatatcacaataacaaagatgttaaataaataacatatgtatattttgtacatattcatcatttaaaacaatgcaaatatacgatttgtaaaaaaaccattgactttttatcctcatgttgttagtatttaacacataagttgtattacttattacctattacttcttacgttccatgacatacatcataattacagtggacggtctttaataaaaagattatactaaattataaagatataaattggaggtaggtaatatggcaatacaaaaaattggccgtgtcaatgtcagtgatgcagtgatggatgagattaaacggttgattagcagcggcgaatggccggcagacagtaaaattccttctgaaaatgagttggcgtccatgatgggggtttcaagggtgtcaatcagaagtgctctgcagaagctgtccagtgttggattgattgaaagccgtcatggagaaggaacatttgtaagtaagttagatgggggacaggtgatgaatatgctcttgcccgttgcagtgcttacatatgataatcagaaatatatggttgaattccgaagagtcattgaaagtgaacaggcttatctggctgcgctcagaatcactcaggaagaattaaaggagataaaggaaaattatagaaagatgcagaaggtagaccctctatcccaagcatgctcagaacttgatgttgaatttcatatgttggtggcaaaggccagcaaaaatcctatgtttatccagacaagcaatatactgagggacacaatactggacaatattttgtacgtaagaaaatacacaaaagaaaaccaggcatttacatatcacaaacggattattgatgcattggaacaacgggatgctatggcagcaaaagaagccatgtttgaacatctggaacgtctgtgggagttgatacaggaaggcagctaaataactatcctctctgcgctccgcttcccctcttccggcaatatttatggcgcatgccttaaatatatataatactaaccagcaagcgaaaggagtactatgaaaaagaggagcgtattgagttttatagctgtaatgatgatggctgctgcagtaacgggctgctcaacatcagccaacacggacactgcagtaagcggggatgcagcggaaaatgaagcggcagggagtgaggcagcaggaacaaatgctgattccggagaatatgcgtatgtaatcggacattacggcggaatcacaggttctgtggcaactgcaggggtcaatggctataacggtattaaactatgtattaaacaatggaatgaaaaaggcggtgtcctgggaggacagattaaacttgaattttatgacgacggggcaaccacagagggagctgttaaaggtgtctcctacctgattgataattgtaaggtaaacgggattattggttctcagttaagcggcaatatcgaatccacaggagaccttgttgaggcatccgagataccggaagttgccacgggcatgaatccggcctggctggaaaagggatggacctatctgttccgctccgtaccgaattcctccggaggtgcagaacccctggtagatgccatggaaaaactcggcaccacggatttgggttgcttggtatatcaggatgatggtaatatttctgcctatacacaggtaaaagatgtcatcacccaaagaggaaccgttaagattgttgaagatgaacaggccatggtaggtgaaacagactggacaggtgcattgtcctctattttatccaaaaatcccaacggagtattgatatttgctcaaagtgagcagggctgtctgatggtcaaacagctgcgttccctggggtataccggatacatctatggaccggaaaccttctccgctccagatatcagaaaggttgccggcgacggcgcaaacggtgttgtattctttactccccactgcattcctgattcagcagaagaaggcaactctgaaatggaaatcgaatttttaaaagcctaccaggcagagtatggggagcttcccacacatgatgttgcctaccgtgcatatgacgccaccaatattcttctgaccgcagtggataaagcaggtacaaaggacggtacggctgtcagggatgccattaagaacttacagattgatatactggcaggccatgccgatttctcaaaattcgataacggagaatgcatgagcggacaaaagattttcgttacccacggagggaaaaacctgaccctggaaaactttttaaaggacaatgctcctgacacatataaaccctgatgctgattcctattcaaacccggcagcattcataaattagagccatgaaatgtgaatgaaagatatgattatgtttcatggctctttttttgaccttttttccggaattttggaggtaaaaaatatgaatatgttaatttctgttattgtaggcgggttggttctgggttgtacctatggaatgctctcccttggatacagcctgatttatcaggcatccggctacatgaatttcacgcaggccacgcttttgatgtttggttcatttctggcatggcagtttctgggcatgggaatccccttcattgcagctctgtttctggctgttatcatcatgttctttattggctggatgatggagcgttttgtcatccgcattctggtaaataaaaaagcaaagaacgtgtatgtagtcctggcaaccctggccctgtcaatcattatggaaaacgcagccatgctgatatgggactcccgcccccactattttcctgcattatttaaaaataatcagataaagattgcaggaaccactgtttcaaaggaaagcctgctgtgtattgctgttgcctttacggcaatgctgattcttcacttttttctcaacaaaacaaaatttggaacagccatgagggccgcagcccaaagtaagacagctgcaagctgcatgggtataaacgtcaatctcaccatcggagttacctatggtattgccgcagcattggcatgcctgggaggcattctggttgcccccaccctatatgtgtcctaccaattaggagcccagctgtccgcaaaaagctttgcaggcgctgtcatcggaggatacggaaacatatacggagccattgtaggagccatattgattggtcttttggaaacctttgtaggagcatatgtctcatcggcatataaagaattcatcgtatatggtgttatggtcctgtttatgattttcaagccatccggtatttttaacgctaaagtttatgaagtgtaacgtggaagaggtgaagtgatgggaaaaaacaaaaaattactgtatatcatcataatagcattggcagcaatcattccattcatgatggagcacaacatcatattcaagcaaagcaagtatatttacctgctcctttgcctgattggtatctataccatcgttaccagcggtctggatatcgtgtttggttatacgggtcagatttcatttggccatgcgggtttcttctgtatcggcgcttacggaaccgtactgctgacacatcctgactggggacttggaaagtatatgggaatgacgatacctcctattatcagtattgtcattgtatcattattggccgccctggtaggtgcattgttagccattcctgcgtcaaagctggtattccactttttagcccttctcaccattgcgttcaaccagctggtattgctgatggtatccaactttgcaggactgaccaacggatatatcggaatcacaagggttccatccatcaatattttaggattctcttttaatacaattaaaagtaaatatacatattattttcttgtcctgttttttgtagtgctgtttctcataatcaaggaaaacattgtacactccagggtaggacgcagttttatagcaatccgtgaaaatgtaacggctgcaaacggctgcggcgtcaataccagcaaatataaaatcatctcctttgccatctctgcgttttatgtggggtttgccggagctttatatgcgcatatggttggatttatcagcccggacacatttgtacagaatacgtccgtaatctttattaccatgcttttgttcggcggcagcggaaacctgtttggtcctatattaggcgctatcataataacagtcatccaggaggggcttcagtcgctttcagactacagaatgctgatttacggaatattcattttggttatcattctgttccagccccacggaatatccggtataggcgaaagcatttcaaggatagcaagaaaacggggaggtaatgccaatgcttaaagtcacaaatcttaccattaacttctcgggtctgaaggccgttgacggactcagctttgagattgagcagagcgaaatattcggacttataggacctaacggcgcaggcaaaacaacaaccttcaacatgattagcggaacctttaaacccacttccgggaccattgaattaaatggggagcgaatagacggcaattacatgtaccagaccaataaactgggggtcgcaaggacttatcaaaatatcaacctgtttaaaagcatgaccgtccttgacaatatcttagtcggccagcaatcccggctgaagagcagtgtcctggcatccattttgcacactccttcccagcggaaggaagaagctgctgctgtggaaaaggcaaaggaaatcatggaattcgttgggcttggacataaagaaatggattactcacactctctttcctacggggaacagcgaatattagagattgcccgtgcactggccagcgaccccatacttctgatattggatgaaccggctgccggtatgaatccgactgaaaagaaccagcttgccgaccttgtactgagaatacgggccagaggaatcacagtgcttttagtggagcatgatatgaaatttgtaatgggaataacagacagaatctgtgtattgaactatggcaagcggattgccctgggtactccatcccaggttcaggcggaccctgctgtaattgaagcatatctgggcggaggtgaatagatggaacccatattgacaattcgtgacctggatttccattacggagaaatccatgcactggaccatgtaagttttgatgtatacccaggtgaaattgttgccatgattggcagcaacggcgcaggcaagacaacactgctgcgcaccatctccggcctgctgggtaaaaacacaggcggaacaatatccttcatgggtaaaagaattgattccatgccttcccataaaattgccggtatgaggctgggacaggtactggaaggcagattggtattcccacttttaagtgtccgtgaaaaccttatgatgggagcttatctccagaaagacaagaaatccatcaaggataagatggagtactgctatcatctgtttcccaggcttctggaaagagaaaaccagaatgcaggaacattatccggcggtgaacagcagatggttgctgtttcccgcgccctgatgggaaatcctcagcttcttatgatggatgagccgtccatgggactggcgccattggtaattcaggacattttcaggaccatacagaaaatacacgatgacggggttaccgtacttttagttgagcagaatgcaaatgcagcccttaaaattgctgaccgtgcctatgtcctggaaatcggaaagcttgtaaaacaaggaccagccgaagaactggccaacgatgacagtatccgcaggacttatcttggagtttcctgataaatctttgaggctgtaaccataaaattttaagtaggaggaaaatcaatatgaaatatcgcaaggaattgttggaagaactgacagcaaaagctcagcagctcagaaaagatgttgtaataagcattggagttggcgttgccggccatgtgggaggctcttgttctgcggctgatattgtagccgcgctctacttctacaaaatgaaatatgacccaaaaaatcctcaaatggcagaccgtgacaggttcctgctcagcaagggacatgtggccatcctacagtattccgcattggcagaagcaggattttttcctgtagaagatttaaagacaacaaaggaaatcggttcctatctccagggtcaccctgatgtgcggaaaactcctggaatagaggctggtacaggttccctgggccagggtctttccatcgggcttggaatggctcttggattaaaatcagatggcctggacagcagggtttatgtcctctgcggcgatggtgaattaggcgaaggccagatttgggaggctgcaatggctgcctctgcctataaggctgacaatctgctggccattgtcgaccagaatggacttcaggccatgggaaaagttacggagcgccttgacacaaatcctcttcctgataaatggaaaagctttggctggaatgtaattgaaatcaacggccatgacatggaggaaatcctgaccgctctggacgaagccgagacagtcaaaggacagcccactgtcatcatagcccatacgacaaagggaaaaggcatcagctttgcagagaatgttgtgggattccacaacggggttctgacagaagaaacctaccataaggcgctgcaggaattatccatctaaaaaacagaaaggaagtacaaatactatgggatatatgaatcaaagagtagcttatggcaacacgttagtagagcttggaaaaacaaatgaaaaaatcgttgtactggatgctgatttgtgcggttcaaccatggggaagctgtttgaacaggcctatcctgaccgtcattatgaaatgggaattgccgaggcaaatatgacatctgtggccgccggattagcccagacaggtaaaataccttttacaaattcctttgccgtattttcagccggcagggcatttgaccaaatcaggcagaccatatccattggaaggcttaatgtaaaaatcgtaggttcctctgctggcttgtccgactttggtgacggttccacccaccagtccgtggaagacattgcatatatgagatccatcccaaacatgactgttatctgcccggcagatgccaacgaaacagttgaggccgtaaaggcaattgcagcgtatgacggtccctgctatttaaggttaaaccgcaatgactatgacaatgtgacagcagaaggaaaaaaatttgaaataggaattcccagtgtgctgaaggaaggcagccaggtagctgtttttgccaccggctacatgacaggcgtggcgcttgcagctgcccgcgaactggagggaaccgtatctgcaaagataatcaatgtaagcaccttaaaacctttaaatgaagaattaatcgtcaagatggctgagggctgcagcggtattgtcacggcggaagaacatagtatcattggcggtctgggaggcgctgtttcacaagcattctgcaaagcatgcaagcccattgaatttgtaggtattaacgacacctttggatgcagcgcacattcctataaagatgttctggattaccatggcctgacaaaggaacatgtgatggaagcaataaaaaaaatagcggcaatctaatcaaatcaattattcaaaaggaggaattgtaatgaaaataggattcataggacttggtattatgggtaaacccatggttcgcaatttattaaaggcaggacatgaagtggttgtttatgatgtagtaagcgccaatatagaagcagtcaaggctgacggagcaatagaagccggttcctccagggacgttgccagccaatgcagcctgataatcacaatgctaccaaacagccctcatgtaaaaacagtggtactcggtgaaaatggagtgctggagggcgcagaagaaggcaccatactgattgatatgagctccattgccccccaggcatcccaggaagtatacaatgcatgcaaatccaaaggcgtcagaatgattgatgcccctgtctccggcggggaacccaaggcaattgacggcaccctatcaatcatggtaggaggagatgaagatgtctttcatgaagtatatgatatcctgatgattatgggcggaagcgctgttctctgcggcagcataggggcaggaaataccacaaagcttgccaatcaggtaattgttgccttaaatattgcagctgtctctgaagcatttatgctgagcaccaaagcaggggtaaacccaatgaaagtttttgatgcaataaaaggcggtctggccggttccactgtcatgaatgccaagataccaatgattacagaaggaaacttcaatcccggctttaaaatagacctgcatattaaggatttgaacaatgcaattgaaacaggccacaatgtaggctctcctcttccattcacttctcttgcaatggaaatactccagaatctgcatgctgatggatatgggcaggatgaccactgcgggattgctaaattctatgaaaaattaacgggaacggaaatcagaaaataggggggaagagatgaaagcattacggtatttaggtccaaagaaactggaagttcaggaactacccacgcctgagcccgccaaaggagaggtattaatcagggtcctggcctgcggcatatgcggaagcgatgtacatggatatcttggtttgaccggccgaagaattgaaccaatgaccatgggacatgaattctgcggcgaggtggtaaaagcagatgcctcatgcagccaatataaggcaggcgataaggtcattgtccagccaatccatttttgcggtgagtgtgttaactgcaggagaggccttaccatgttatgcctcaacaagcgattcttcggtgttctcaccgttgacggcgccatggcagaatatgtttctgtacctgaaaaattattatacccacttccagacagcagctctccccgcataggagctctcgttgaaccatacgcagtggcttacggcagtgtcttaaaggctggtgatgtggaaggaaaaaccgtattaatcattggagccggaaccataggagcatgtgtcctgcaattaataaagcttaaaaatcccggaaaactcatcgtatccgatttaagcgatgccagactgaatacagcactggaattgggggcagacgcagtcattaatccttcaaaacagaacttcatggaaaccatatcccaattgacagacggtttcatgattgacacctccattgaatgcgtcggagtccagccatcagccaatcagtccattcaatgcctgaaagtaggcggtacctctgtttgggtaggtatgtcccaaaaagaaatgaccatcaatatgcaggatattgtatgctcggcaagacgcgtaattggaagcttcaactatacccacaaagaatttgggcaggtggcagagatagtcacatccgggaaactggctactgataaattgataaccaaggttgtatccctggaggaggccgtagatatctttccggaaatccatgagcatcctgatgattatctaaaagtcatcattgagcctcaactgtaaataggaggaatgaaaatgaaatacggctgttgtcttaatatgattgcatccaacccggataaaacaggaatcgaacatctgaaagccctggcagcgtcaggttacgattatgtggaactccctcttgctgaaatgatggatttgccggaagcacagtttaatactctgattatgaatgagttggaacaatacaatatacagtgcgaagtatgcaataatttttttccgggcacaatccgtctcacaggcaaagatgtagaccagttacagattatggactatgtaaaccgcgcccttgaacgggcaaaaagcttaggcgtacaatatgttgtctttggaagcggaaaggccaaaaatgttcctgacggatatcctctggaaaagggttaccaacaggtagtggagcttcttggacaaataggtcctgttgcaaaaaccaaggggataacaatcgtaatagagcccctgcaaaaggctgagtgtaatttaatcaacacttttgaggagggatgcagactggcctctgatgtagaccatgagtccataaaagtactggttgacttctatcatatgacgattgaaaaggaacccctccttcacctggaacaaaacgggaaggaatacctaaggcatgtccactttgccaatccaaacggacgtgtatatccaaaggatatccaagaagcggattatattccattttttcaggttcttgaaaaaatcgggtatcatcagagaatcagctgtgaagcttataccgatacgttcggtaccagttcagctgcagcgttaaatgtactaaaaaatccgctgaacaactaaatatacttaaaaggagcagactacataatctgctccttttctgtggcctgaacttatcccggcttctctgaatatcagaatctattatccacagttttttccttaaaaagctactgtctgtggataacatttactttccctctcatttctgttaaaatatatccctgtaaactattttaattccatgtcagacacggtttatcaacattgacccacagcacaaaagaaaagaaggtgaatccatgaaaattgtcatcatagacgggcagggcggaaaaatgggaaagtcagtcatcgagcagctgaaaaagcgtttcccaaatctggagacatatgccatcggcacaaacagcattgccacctccgccatgctgaaagcaggcgccacctatggcgctacaggtgaaaacccggccatagtcaatgcccaggatgcagatatcatcatcggccctatcggcattgtcatggcgaattcccttttaggggaaattacgcctgccatggccacggccatcggcatcagcaaagcatataagatactgattccggtgaaccggtgcaatcactacatcgtaggctgccagaacagcaccttatctgactatatcaatatggtatgtgatgaagtgggaaaggaagcaggtatcaatgagaaccattgaatttaagatggaacgccagggccttgtgaacaaaggcgataaagtaaaaataatcgagcgggaaggaaccagcagctacagctatatcatcgaccctgctgtagctatgtccggctgcttcgccgcccgttaccgtatcaagtctggatacggaattgtaaaagacatccgtgaaaattcacggggtttttatgtgatagtagattttgatgaggacgaaccccgttaacaggtaacacttctcttaatccaattttaacccaggggcactatcttcacctctgcggacggttccgttaccggcggaatggtaggggccggagccggcagcgtgggagcagctgtttccgtatgaggcccttccgtactgattacagggtcattatccacagaaggctccaccggtgaaacagtttccgaagaggaagggggcatggtctcaattggctgaataatgtcccctgactcctgggcctcactgctctcctgtgtttcttcagaaggaaccatatcaatcaggctcctgtcaccggcatccagttcaatggctttgctccacagaatactggttattccgctgtttctgtcccactcacaatcatgccacaggcaaatgaccttaccatccttagccataatgatttccagcatatcatttccgtccacatgcttaccggtccgagcggctgtatcatttatctgataaatattcccgtctcttgatataatagcagctgtcccataggcctgtttccagatagccggattgtattccccaaatatctgtccctcatcctcgtagtagtacatattctgcatcacacctgggaaacgctccgacactgcctgtttattctgtccgctcaaatccgtcctgaatatctggctgtaccattctcctcccgtacctttatccacataactgctgtaataaatctgattatccacaatgcaatagctctgtacaccatagttttccctgataatggcagtatcgttcccttcgctctttacactgacagaagattttgttccgctgccgctcagataatacgtctttcctcctatggttacctgaccgtgttttacatattttatctttccgtcttcctcaatccggtaaacacggtccccaatgctgacactgctgccgctttcagccactgcaggattgcccaagtcatctaccagataacaatttccatcctttatgaccaccgaatatctggcttccccagtggccacctcggtgcctgaggtggtgctgtaaatcttcccggcctgggagtaatagattgtatcccccattaccatatacccatccacgttctccgcaatcagctccttggtatcgcttcccggcctcatcctaaacagcttatcacaaagccccctctcagcctcggaaaggccctgtttctggctttcttttaccttaggcaggaaatatacgtaatcgccgtaagcacgcatagaattccttgtggtcttttccggggccgtctcccctcccagtaccaccaccttgttctctacggtcttgcggtacaggatggtcttaaacagtcctgtgtcttccgccctcagataacaccagaacgcattggtcctcaccaggctgtccaggttttctcctgtactctcaggtttgtagtccaaatcaatttggatgtccttcagatagccctttgtgtcgtggcaggtataggtctgtccctcctgttttaataccccggtggccatgataccgtcgctgtcaaagtaatacagaaacccctctatatccttccactgggccgtcacgtactcttcttcatccagataatacatccatccattatcagtctcattccatcctggctttggttcctccctggtatctatggtaatggaaggcatctccttctgctcagtactgaaatccagatttttataatctgaccttattttcccaaccactgacataacaacatacacagccgccgtcataataacagctgccatgataatcaaaaatacagtcttgattggtgaatccttttttttgcgccgtctgctcattcattttcccctggtatcttttgttagtagtatacttaaaccttaaaacattatttatactatcagactttcagcctttttacaatgaagtaaatcttacaataaaacaaaaaagcacccatccgtcaaggataagtgctgagtgcccaaagtcggaatcgaaccaacgacacgaggattttcagtcctctgctctaccaactgagctatctgggcatctgatgagcgtgccgggattcgaacccgggacaacttgattaaaagtcaagtgctctaccgactgagctacacgcccataaggtttaagtttttgcaaaaaaaattgcgggggcaggatttgaacctacgaccttcgggttatgagcccgacgagcttccagactgctccaccccgcgctagtatataattataaatgttttaaaatgttttgtcaaccaacattttaaatgggcgaaggtggattcgaaccaccgaaggcattgccagcagatttacagtctgtcccctttggccactcgggaattcgcccttattaaattagtatatacacttttctgtaaagaatacttaaatggggcctacagggctcgaacctgtgaccctctgcttgtaaggcagatgctcaggttctaacccatggcttagcaccatttttttagttcaactccgaaagacaggtttcatatgtcgtcaatatcgtttcccgccagtaatgtaaagtctatgtaaattatgtgtaaaatttctcccggagatacatatatttacaattaatctccgggacggaaccgcagtattatccgattattgagtatattgtttttccattttcatactgattttccaaaagcgggcaggaacgccttaacgggcggcctcatgttcccggccatagacctcaatctgtgtcagggcagggaagggagaggggtcgtccgccttgatgagctgaccaaaggtaagccatgtaatgcctttgcgctccagactgatgatgtggggttccacgctcttttcaagctccactgtctcagaggttccgtctgaaaaggtaaatgtcaccctttcccaccagttgtcatgagggaagtccgccctggtatagaggacaatccggtcaaaatcaacgggacggccgaactccagtgtcatttgggcatcatcctgcatattgattccccatgactcatagggccattttccgtgggacaggttcgccgtcaccccgtcaatggcgttgcgggccgcaaacacagcctctccccttgtctcaacattggcgtgggcatggggataaaagccctggcccttgtgctggtccatgacgttctttgccaggttgcggtaggagctaatctcatagtccaaggcatagcgcactgtcagatagtggcgctcccctgtaaatgacttagggttataggatgtcttgccctctgcgaagggaacctcatagaccagctcatctccggccgcgtaaatgaatgactcgtccatggtatcatccacacgcatgatatagaaacagttcttttccggcagggagaatataatcctgtctccctccccgtattcgcccttccacgccaggacagcctgttcttttcctgcggcctctgccttcaccgcaccgtttttatcctttactgtaatctgcattcccatgtatatcgcacactccttttatatcaatttttcaggttctttcattctaccatggagcgccgtggaataccatatacaaaaaagtttaaatgatataaaattttaagctgaattttaagctttgccgaatattctattatttacaaaatttttactttttattcatccgggcagctgtttctgatgttataatagaaaaaataatgaatgaaggggatgattggatgaattggaatgaaacactgagaaacaacgtaacccgcgccgaggaactgagaacgtatatgaggcttagcagccaggaggaggaacacatgacccgaatcctggaactctttcccatgacagtcccaagatactatctgtccctcattgactggaacaatccggaacaggacccagtgttcaggatgtccattccctccattcgtgaaaccgacctgtccggggactttgataccagcggggaagcggacaacaccgtgcttcccggcctgcagcacaaatatatgcagacagcgcttatcctgtccacccaccggtgcgccatgtattgcaggcattgtttccgcaaacggctggtgggaatatccgatggcgagacagccggaaacgtggatgagatgggtgcctacatcggttcccacccggaaatcaccaatgtgctcatttccggcggggattcctttctgaacagcaaccaaaccatacgccggtatctggaggtgttcagctccatcagccatctggacttaatccgtttcggcacccgcactcctgtggtgcttcccatgcggatttacgatgacccggaacttctggatattctggcctcctatgcaaaaatcaagcaaatctatgtggtgacccagtttaaccattcaaatgagctgactcccgaggcagtaaaagccgtccggtgcctgaatgaggcaggcgtcatagtaaaaaaccagaccgtacttttaaaaggaatcaatgacaacgtgcggatacttggaaaccttctaaaggacctgacaagatacggcgtcattccctattacattttccagtgccgtcccgtatccggtgtaaagggccagttccaggttcccctggcagaaggctgccgtattgtggagggggctaagaacatgcagaacggacagggcaaatgcatccgctacgccatgtcccatgtcaccggcaaaatcgaaatcctgggtcttatggaggatggaaaaatgctttttaaatatcatcaggcaaaatacgaaaaagaccggggacgtattttcagcaaggagctggcgccggggcaggcctggctgtaaggcagagccgggccgcggggcggtagctgagccgcggggcggtagctgacccgcgggccggtagctgggccgcgggccggtagctgggccgcgggcgaaagctgggccgcgggcggtagctgggccgcgggcggtagctgggccgcgggcggtagctgagctatgggcagacaatatcgaagccgcaggacatatcccgatatggggatgtcctgcggcttttcttgtgccatggtttttatgccataggctgcttatgtatttacatcaatgacagatacaggttcttgatatcttcaaaggacgggtcctttggattgcccggacggcaggcgtcatccattgcggactgtgacaggaaatccacatcctcaggctttacgatttcctttaagtcagccgggatacctacatcagaggacagcttcttcactgcgtccactgctgccttgcggtattcatcctcagtcatgttctcaacgccttctacgcccatggcaatggcaatgtctttaaacttggtgccggtgcagggtgcattgtattccataaccgttggcaggatgatggcattggcaacgccgtgaggggtatcatataaagcgcccagtccgtgagccatggagtgcacaattcccagaccgcagttggagaatcccatgccggtcagatactggcccagagccatgccttccctgccctcaggcttgttctccaccgcatccctcaggctgcgggcaatgacttcaatggcttttaagttaaacatgtcagtcatctcccaggcccccttcgtggtatagccctcaattgcatgggtaagggcatccataccggtggcggctgtcagtccctttggcatggaggacatcatttccgggtcaaccactgccacaaccgggatgtcatgggtatccacacatacgaatttacgctttttctccacatccgtgattacgtagttaatagtaacttccgccgcggtgcctgccgtagtgggaactgcaataatcggcacggatggattcttggtgggagcaacgccttccaggcttcttacatcctcaaattcagggttggtgatgatgacgccgattgccttggatgtatccatggaggaacctccgccaatggcgataatatagtctgcgccggatgctttgaaagcggcaacgccggtctgcacgttctcaatggttggatttggtttgatattggaataaatctcgtaggcaagtcctgcatcctccagcacctttgtcaccttgcaggttacattgaacttaatcaggtcagggtcggaacatacaaatgctttcttaaaacctcttgcctttgcctcatttgcaatctcctggattgcgcctgcgccatgataggatgtctcgtttaatacgattctgtttgccatgattctcttctcctttactttgacggtacgccgccggccccatatcatgtgtcagcggatttgcttggttgcttttgttaatattataacaacacggaatttaaaataaaagtgacaaacatccctgtctgtcactttccttaaaggtttgtgcagtttcaccatctggaattatgcacaattactattttacgtctctgtttcaacagcagatgtccatggattaaagaagctttagtttctcaaaaacctccgccagctttggcggcatggcttccaccagcttatcggacatttccacgggcgagtctttcattcctcccaaaacccacttcacagtcatgtatacggaaccctggcagtacatctccagaaggaactgaagctcctggcccaggggctggctggtcttcctggcaatcaggtccgtatagaactgcagaatcagttcaaaatcatgttccttcagcgagttcctgtcatcggagcggaaggcctctgtaaaaaacaccttttcattgagaatgaactcaaacttctgtgtcaggctctctcccaccgtgtgccccatgccaatctgctcaaaagactggagcaccagcttatcaaaataccagtttatcaggtcgtatttgtccagaaagttccggtaaaaggtctgccgggtcacaccgcagccctccacaatgttcttgaccgtaatcttatccacgggcgctgtcttcatgcactccttgacggattctgccagcttgtattttgttttctcctgctttcctgttacggccatgatattcctcctgaggcaggtactgcatagtgaggccctggtacctgtgtccttttgtaactatctcttcacgccagcaggcagtgcagccatagtcctgctgcactgcccgctgcttctatggacagtatatcaaattttcagtccgtcttctacctgtttttgaaaatgcttaccattgccttccacatctgtaccaacacgttccacatccgccttaaggggctttccttggtcttggccacttccgcgtccgcagtcttggccgtgtcatcatccacactgatttcatcggtgcgcatgacaatctgaagtgtcttaggcggtttattccggtccgaagtaaaggataccttgtctgcagacgggtccatgaacaggaaacggttatctgtatcaaacttatccagctcattgtcaatagtatccttcatggtgcgtcctgcctggcgcatcactgtggtgctgtccaggatgttcaggctcttatccagaagttccatgctgccgcgcagactgtctctggcagccgcgtcaaaatcatcactgctttcttttagtgtgttctggatgatggtcattgtgctgattccgctgttcagggcgtcggtggtgcggcgcaccagttcctgggaatcatccagggctgtctggaggtccggataatatacatccagagaatcgttgagagccttcaaatcctcaatcagataatccatgttgtcaactatctctgcactgtattttgctgaatcagatgtatcgtccatcagatttgacatcttcactgtcaatgatttgctctgggctgataaatccttgaggacctctaccttttcatacagggactgttcaatggttgccgctgcatccgccggattgggactgcttaacagcggggcgctctttttctctatggacgcgcctgccatcaaaccggacaagccggactttcctgtatgctttgcggaaccaatgactgtacctgcatccggggtactgctgccggtatttccatctgcagatgaacctccgctggtgctgctgccttcggctgtgcctccgccggtacttccgctttcggtgctcccgcttccgccggtacttccgctttcggtgctcccgcttcctccggcacttccgcctttggtgctcccgcttccgccggtactcccgccttcggtgctcccgcttccgctggtatttccactttcggctgtgcctccgccggtactcccaccttcgttcccgcttccgccggtatttccgctttcggtgtttccgcttcctccggtacttccgctttcggtgtttccgcctccgccggtatttccgttttcggtatttccgcttccgccggtactcccgctttcggtgctcccgcctccgccaatacttccgctttcggtgtttccgcctccgccggtacttccattttcggtatttccgcttccgccggtactcccgcctccgccggtacttccgctttcggtgtttccgcctccgccggtacttccgctttcggtatttccgcttccgccggtactcccgctttcagtcccgtttccgccggcacctccatctggattatccttcccatcctcactgctgccggaatttccgctgccctggtcattcccctgaccattgtcctggctgctattctggtcacttccctggctgccgcctccgccggaggatgaatggcttccaccgccggaagttccataatctgcatcatccatgtcttccagctcttccgcatccagttcctcatcataaagtcttctggccttggcgctggaactcttatacaggctgagatacgtaagcagcgtgtcctgggatgcctgaagctgtgtgtccagtgccataatggattccatggtcttctgaagctccggcaggtcgctgctgataccccctgcgctgttttcaatgttcttaagtctggtctgcagctttctcaaggggtcctgcatgtctcccaatgtattgacaatatcattcatgctgctgtgaaccacttcagcacagtccttggctgtctgcaggtgcggaatcatggtatccatctgctgtgacacggatgtaagcgctgccagtgtctggtcatttccggccagtatgctgtccttggaattgctccacttctgtctggcgttatccgctgaatccatgccctggcgaacctggttcacaccctgccgcatgttctccacagactcagccatctgctccaggctgtcgtaaagctcatctcccgcatcctgccaggtatccttggcttccttcaggtccttgatatgctccaaatcctcaaccgttcccggcaccatggccataatgacacctatggtctcaaagctgtccgtaccgatgcgcaccgtataatccccatcctcgcccggaagggctgtaaataccacagccgtggtatcccccaggttctgggtctgggagccttccgcctccacactgtagcatttactcatatccacaggcacagccaccatgagcatcatattgttgcggtaatactccctggcattgtcactgggctctgccttcacattgatttcaataagcccggaagcccctgccagcttatcgccgtctgtgggtactccgttaagcttgtaggatacgtcaaaatcccagggcagcacaatcctgtctttatccacagcacatttatagtaaaatcttcctctctgggcctccggaagcttccatgtgacggtcccgttccccagcaccggttcaatgctgttggacatgttaatcacagccccataggtaccgtaatccgtaaactcggtctgtccattgaggcccactccctttaccacgttaatcttatccaccctgccgtaataatccaggttcacatacatggtttcatccacgtcaacggtggcttctgctccgtatgctggtacgccgccggtgccggtgcaaagcatgacaaagaccattcccgctgccatgattctcttataattcattctcatcgctttccacctccgctggttcaaaatctgtccgtctcaacgcagacgccttattgactacggcgcctaatcccgcctttatcagtgccttccgcttttcatggcgccgtttcagatgtttctgcaggcggtcccactcattgctggtaatgatacggtcaaagagcaccaggagagccggcagcacggtcagcaccagaattacgctgaacagcgctcctcgtccaatcaggtgtcccaggtcccctatggccgctgtggttgatatgaaatgtataatatatcccgccagtatgatgatggttcccgaagtaaaaatagagggacaggacagcatcagggcctggatacacgcttccttcttctccatggttttcctgcaggacacgtagttattggtcagcagtatggaataatccactgtggcccccagctggatgctgctcactatgatataacccatgaacaccatggtatcccctgccagatacggcatggccatgttaaggaagattgccgcctcaataggcaccatgacaatcattggtatggcaaaggaccggaagctgaacatgacaaccaggaacacacccagcatggataacaagttcaccctggagttatccgctgtgatggtggttttaatatcctgggtggaaggcgtttcccccaccagataggaattctccggataataccgttccaggatatcccggatttcatccgctcccttaaatgcctgttcactctctgtctttgtccgtatgtaaatgagcatcctgcagtaatcctttgtgtgaagctcactggtaatggaatagggcaggaaatcctccggtatgccctccggcagtgtattggacagggaggtcacactctttacatagggaaggtcctctatctcatcggacatttcccgctctgtcactgccgaagtattgggatacatggccagcatcatgttgcttcgcccaaattcccggacaattacctggtcgtccgcatagacctgggttccctcgctggcccccacagcactgttgccgtacagaaaatcattcattccctgggccacataagcaggcggcgccagaatcagcataatgataagggatgcgtagcgcaccctgtaaacccattcgctgaatttccggaagggcggaaggaaggggcggtgccgtgtcttatcattccacttggaaaacttaagaatcatggccggcataaagaacagcacggttatcaggctgaacacgattccctttgccagcaccagacccatatcgaacccaatggtaaacttcatggataccagtgccaggaaccccaccacggtggtcaggctgctggcaaatatggagttgatggcagcgtcaatggcattgaccatggcctgctcttctgaacagcccttctgtttttcccttgaaaatgcatccagaaggaaaatagagtagtccatggaggttgccagctgcagcaccatagccacattgttggtcaggaacgagactgtcccaataaaaatattcgtgccccggtttaacagaatggccactcccattaccagcaggaaaaggaagggctcagaccatgccgtggtgctgatgcacagaaccacaaatatcatgatgacggcaacggtaagaatgagattcatttcgctctccacattttccgtcagggatttattctgaaccgccattcccacataatatcccttatctcctgtgatggccttcatctcgtcaatggcctgggatgtcttctttgccgtatccccctcatcaaaggtgatatccatgacagcgcagccgtccttgtagtagtcctcaatgtcctcctggcgtataaaatcctcgcctgaatagatattcaccgtgctgtcgcaccagagaatctggtccacaccatccactgcttccagcttatccttatactgctttgcctcatacaggctcacatccttaatcataagcctggcagtgcccggatagccgaattcgtcctccatcaggtccagcccgatacaggacctggctgatgctggcaggtactctgtcaggtcataattcacatttacaaagagcatcgctatcagtgaaaagacacaccctgccacaaatacgctctcaatccatccttttttatgtatgataaatctagccatgcggaaggaaaacttatcccctgcctgcatctcctgcccttttaccctgtgcatcctgtcctttatcctgccaaacagcttctgtcccatattccatgctccttatgccgccgcctcatggcggccatgccccgcggccttatacttccctctgcattcccgctgaccgcgttcctgccccatacgcccgccgctctgcgcattcccccgcctaccgcatcagaatcaccataaaatactgtttcccgtccttctccctgtgagccatgcccagacggcggtaatattccatggaatacttccggtcgttcttggactggcggcgcttatccagcttttcttttattttgtcaaatgcctctgatgcatccccgcagtcccttacatacagctccaggcaggaggcattccttctgtaattaataagggaaaggtaatcgttaatagtcccctctccgggaatcctgtcatctgcatatcccccttccatggctccgtccagtctgtggtccgccgccttgttgagggccatatccatctgaaagcctgcataccggtcataaacacggtgcatgtcaccgtcatattcatcttcgcggtcagggtattcctcaaaatataaatccttcttttcctcattgagctggtcaaataaatcctgggccatatggccgtagcatcctgcatcgtaggcccctccgcctgtattctccacccagccggctgaaaccagggctccctgtgctgaaaactcatattttccattatccagtatcagctctcccaggttcatgcctccgtcttcatggaagtaataccactctccgtccacctcccgccagccggcagccatggccccgctctcgtccatataataggaccttccgtccgcactgagccaccccttatgtaaacttccgtcctggtccagccagtaccattttccatctgcctggttccagcccggaacaaacgaagcagcccttgcctgtgcctgctcctgtgtctgttcctccgccagggccgtaacggtcacggacccatcaagggcccacaaaactcccgccgtagccagaatcactgcatatgttctatatttcatgccccctgcccccgtttcttatatatatatctattatacatcttttataccgttaaacaacttctattttgttaattgacttttgtttatttattgactataatggattataataaattatggcaaaaatacaatgattaatttccattattttgacggttaatcaacaaatttaccatttttgtctagaatacaattgttaaatatttgtaaatatgcgcaaacctatataaacaaaaggaggaacagataatgggcatggaacctgtggaccgccgggtacgcaagacccgcagacagcttcgcgaatgtctaataacattgctcaaggagaaaaaggtccaggatatcacggtccgggagctgactgacatggccgacttaaaccgtgggaccttttatctccattataaggatgtgtttgaccttctggaaaaaacagaagcagaactccaggaagatttcaaccaattggtctgtaagcacggagctgtggatttaaaacagcgtccatccgtcatattcaatgaaatatattccttagtatatgataatgcggacctgattgagattcttctgggtgagaacggagacttgaattttctaaaccgtctgaaacagcttatacgtgaaaaatgcctgaaggactggatggaagtattccgctccggcaatgctgctgcttttgacgccttcttctccttcatcgtatcagggtgcatcggcctggtacagtactggctccagaccggcctcaaagaaacgccggaacagatggcaaagctgacagaacacatcattaccaagggaattggtgtcctggaaatcgacccctacgtataatgccgtctgaacagttaccatttcctatagataatttcttaatatatagtgtcatgtatggccataaaccggatgaatttttctccatgttatgatatgatgggaaatacatcacaacagaaaacaggagaatacaatggaagcacgaattgaatacagcccaaaagcaattgtccgtatccgcaaagggcagggacgttccctgaaggccggaggcgcatggatttacgacaatgagatagagagtatcagtggagcatttgaaaacggcgacatggtgacagtggaggactttgacggatatccccttggcaccggcttcatcaacacccggtccaagctgacggtccgcatgatgtcccgcaggaaggatacggtcattgacagcgattttctggaaatgcgggtacgcaatgcctgggattacaggaaggcggtgaccgacacctccagctgccgcgtcatattcggagaggccgattttttgcccggtattgtcatagacaaattttcagatgtgctggtggtggaatccctggccctgggaatcgaccgcttgaagccggtcattgtggacaagctcagaaaggtcatggcagaggacggagtaaacatccggggcgtatacgagcgcagcgacgccaaggtccggctgcaggagggaatggagcgccataaaggattcatcggagaagcatttgacaccaaagtggaaatccaggaaaatggggtccggtatatggtggatgtggaggatggccagaaaaccggcttcttcctggaccagaagtacaacaggctggcagtccagaatctctgccgccgcatcaagccggagcaggtgctggactgtttcacccacaccggttcctttgcccttaacgccggtctggcggggtccgctcatgtgctgggtgtagacgcctcggagctggcagtaaaccaggccagggaaaatgcggccctcaacggtctgacgaagcaggttcagtttgagtgtgccgatgtcttcgaccttcttcccaggctggagcaggaaggcaataaatacgacgtggttatcctggacccgcctgcatttacgaagtccagaaattccattaaaaatgcagtcaagggctaccgcgaaatcaacctgagaggcatgaagctggttaaggacggcggctatctggccacctgctcctgctcccacttcatggacccggaactgtttaccaaaaccatacgggaggcagccggcaatgtacacaagcggctcagacaggtggagtacaggacccaggcagcagaccatcccattttgtgggcagcggatgagtcctattatttgaaattttatatttttcaggtttgcgatgagaagtaggttataatatgaaaaatccctgaataccggtttgatatgaaatatgagtcatttccggtgtttcagggatttttcttttattttccatgaacataagaacgaaaaaacggataaactataagtgagacagtaagataaaagacccattattccatgttaacagctgtatctttatcaatgtacattgatagaaaggacctgacatgattatacttatcatattcctcatactgactgttctgtccatactggtctgctgctttgtggcaggctcagcaccctatgacagggaggctgacgatgaagcacagctggaatttctccgcaaatacagggagtccagaaaataggaaaaaagaaagccgcaaatcccctgctatgcacggtatctgccattcttccgcaaatgccgcacatagcacacggtaaagaatatgattccataaaccgatgccgccggcacagcaagaccaatatcaaagagactggcaccctctttcagactgaacaggtaggacagaggaaccctgataaggaaggaagcagtgatgccatggaacattatggccagcgacatgccatggccgttaaaatagccgatgtagctgaataccaggcaggtaaggatggcttcaaagctgtagcccttagatattctacgagagtatgaagaaaagtctgtagataagattcttctatgataataaagggtgaaaagtctcaaaatgggcttttcgcccttgctatatatataacagttacaaaaaggcatatcaacagcaggcggtaaatccgcctgttattcggtcatgttcgattactccggaagccgtccttcgtacatgatacttaattcgccatacacttgagcccagtgccggatggctgtggtctactcacaacttccacatgagacaaaaatactaacaaaaatgctactgctctatatccctgaagcgtaataattttatttttttgcaactgtcattaaaccaactctccgttgtttattaacttaatcatgaatcttatttatctttctatttattcagtgaatagaaataattctgtcaactatgttagttgtagatttacctttgacaacttttattaactctaatcttccacccctggcttcaactatatctcttccaacaacttcatttggtttataatcatttccctttaccaaaacatccggttgtatcactttaatcaattcatatggagtatcttcatcaaataaaataacataatctacatattctaatgcgcataatatctccgctcgctcacgctcagtattaattggacgattatcaccttttaatctttttaccgaactatcactatttaatcctacaataagcaaatcacctaatttagatgcttcctgtaaatatctaatgtgacctacatgtagaatatcgaaacatccatttgtaaaaacaatttgccttttttcatgaatttttcttatatcttttgcttttttataatcaaccagcttgtgaatcaccccttctttttcattcctaacaacctcgagaacttcatccacataaacggctgatgtacctactttagccacctgtaaaccagccgcataattagcaatttcaacggccctttttaggtccatattatttgcagcacatgcacataaataggatatcgttgtatctcccgcacctgtcacatcaaatacttctttgcctactgaatttactataaaaacttctttatctcccaccaatctcatcccctttgagccacaagttgccaagacaaattggcatgctgaatttctcctcaattcctgagatgcaataattatttcttcttcagtttcgactggaagcccagtcaacacatgaagttccttttgattgggttttaataaataggcccctttatatttagcaacattagaatcttttacatctataaaaaccttaattccgacttctttagcaatctttataaccccctgtgtaaaatcatatgtaagtaatcctttcaaataatctgaaaaaaccaccaaatcgaactgaccaatttcatcttttagcataagtaaaaatttctcacattcctctgaggttatagaaaaagtatcctcttcatccagtctcattacttgttgattattactggcaataaaacgaacttttgtagttgtatggcgttttgtccgaataacaaatcgggtatctatagatgcatcttttagctttcggataatttctgcacctacgctgtcgtcaccaattattgtcatcattgaaacttgttgattggctgcaattaaattggctgcgacattagcagctcccccaagtacatttctctcagattttttcatgaaaatcggcactggtgcctccggtgatattctattgacctcgccctcatagtaaacatccatcataacatcaccaattactaaaatacgctttgaatcaatcattttttacctcttcttctaaaaaaacctaacaagatttttctcaattcatctgaccccagtgttattgtatcctgaaatgataatttcatctcttggtgagcctttcttgtccaagaccaggcattatataccccctgacttatcaattgagacccgataagtccccatactccccagttaaaataacccatgcatattattgctaacataacacagccaattgaagacatcagaaatgctttgacatatggtattctgtttgtacatgaaaaatatgatgtatagcaatttctaaattttaaaataaactggtataacccaattcctaacattacgcttatacttacaactgcttcagggcgtataaaacgaagcaatggtaagccaatcgttacagtaaagaataatcctactatgttgagaaatgtaaatgaaacaattatcaaggacattgttcttttttctttctcagtatcattgttaatgcatactgattgcagtactggctgatttgcagtatacataacagctgaaatttgtgaaatggctgatgcgatttgaactgctaatgaatatgcgccggtttgagttaaaggcatatataatgaattaataatggtacaagattgattagctaaataatttgatagagaaaccaaaccttcacgccatgcattgtgccatacaacaagaaaaatactctgtatctcttttctgggtaaaaatacagttattttcttcagaccttctccaattcctttaaacctgtaaaatctaattttagccaattggcgaaataatgtaccataaactaaataggccacacttatacccactaatccatatcccagccaaagaagaaagattgtcaatattatttgcgtaagtcttgataaaacagtagctttattaacgtcagagatagccccaactcctcttaaaaaggaaccataataaccaaagtacagattcaaaaaaatcgcaagcgaatatataaaccaagaaatgactggtgtctgtccttctatagaaaaagatatatagtcaatatatagagttcctattgttgataacagaataaatgcaagtgatgcaagcattaaaaatacaattctacatgccttcatcgtttctttcattaggtaaaaatttggttttgaagactcggaacaaattatcccatttttaataagcctatcagccccattccaacaataatttatatttcgggaaaatgtagttgaaaagccaaaatcaaataatgttgtgattgctgacagactttgaaaaactccccacaacccaaaactatttccatctaaaaaatacataacaaaaggggtcataattacatttgccagcaaagataaaaaaactcctgcataactccatagataatctttatttgtaatatgtatattcataaattatcttttaaccttttctatatcttcttttaaaagccatatccacatatttacaaaaatatgcgcaaaataacatcgcccatatagaagctccactatgcctagtgaaaatttcaactaccaccatcaaatacacaacaaatatagataatgaaagtatccgggatgattctaattctttgttttccattaaacgtttcgtaatcagaaggtttatcaatacatatataaataacattgtaatcccaccaataaaagttatctctaaaagttgattgtgagaatgaacaactccccgcagtccatacattatggttctagtaccattatctaatatcccatttccatatattatcttttcctgaatatattttaaagtcttaggccaaattataactctatatgataagtttccggacttccctaaccaccccaacaccgtcatccccaaggtcgaattaaccaaccatgcagtcataaatataaacattatatttgcaagcaaaaccactaataaataatttctcatattaaatactttttcaaatttaaacaaattcaaaagcaaaaaaaacaataaaacaattacgccaacaagaagcatcatattgtgggatattatcgtctcgacacaacatgttaaaaccaataaaatcattctcactttctgactacgatatttataatttatccattcgaagcacatcacaggtaaaatataatactgaaaggagcttttatatccaaaaatccaggctaaatatgaattatttgattctacatagtacatacctgttgggtaaagaatcatacatatcagattaacataaatccaaaattccaagataagtaaaaagctgttaatgactaaatctatatcatttttaatagaatcaataattaaacaagtcatcacacatggcataaatgaaatatatgcctgaactaaatttccgttattagcaatggttgttacaaaagcatccataacaaataagatagtaaccagagctaatttttcaattttcttatgatttgacttaagtaaccaaatcaaaccaattataataaatacaactgttcggaaatatagataaaccaaattataaaaaaaagggtgcaacgataataatccttctggtgatattaaaggaaaaatcaaaaacatcaaaataatctgtgtatatgttatatttattttaaatattgctttaaatcttttagtttccagtttcattacatcaaatccatcctccctaatcataatcgtgttatgctaattatttggcatagtgatttcagataaaaaaacatctatttgttcaataatctgttccactctgatttcagctacacagtcataacttttatgatttgtaagggtcattttgcaactagaatttggcatcaaatcaataactttgccacaattctcacatggtaatttagtttcacaaaatattggtaccgggatatttttgtcggctatatccaaaatatatggataaaatcttttatattgccattttccaactatacaaatcgcctttacacctgtagccgcagctatatgaaccgaagcgctatcatttcctatgacaaatctagctgaggcaataatattcacccattcttgatagttggttttacctgtcaaatttatagttctgccttcagcatgaacttttccgattatatactctgtatcctctaagtcagattttgctcctacaaaaatgatggttaaatcagtcatcttttcaatatagttagctaaagcgacaaaacggtctttggcatattttttgcctgcttctgatgcgccaaccgcaaaaacacaatagaattttgcatatttaaagcaagattctttttttataacaggaattccagttttatattcacaatctcctaaaaatgacattattcttttgaatctgcaaaattccatttccgttttatctacaactatagtgtcgctatatgccaatcttctaaaaagattactaattcttctccctttgataatcatatcgtctcttacggccagtttatacttaccattaatacagccaaccaatttatcacctttatgttttggcaaaggatttagaacatattcatattttttgttcttaaaataatgcagtacacgcatcatatccaataattctgtattctttttttcgaaacatatatccaggacattcaaatcataaatttcacagcattccaaataaaactcttttacaaaagactttgaaaaaaataggtctaccgagtaccctttctcttcatgcaaatatctattacattcttttaaaaaatcctgtactagaactatgtctccaataagtccatcaataataagaagaatacgtttattttcttcctttttatgtaataacatgcataacatctttacatatacatatatgtttgttataaatcttctaataaaaatcattcctacctacccagcaaatctttatgtcaacacatcagaccatcaaagatatataaaactcttccaacttttttgcttcagtacaaatatcaaatccagcttttattaattgttctcctgtgtttcttctctctgggatattctcaagcttagagagtattgtatccgcccacccctttgccccaatacttaatggtatatattccaacaaattcgtaactttagcctctttcgtcacactgtctgatacaaaaattggaagtcctgctgcctgagcttctattaaaacaaaggctaatccctcatatagcgaaggtaataaaaaaatatccattgcctgcataaggtcagcaatatcatttctaacccccataatcacaatatcgttgttcaatccaagatgtttaactttctcctctacttcatgcctcagctcaccatctcctaccagccacagcattgtatttccattttttttgtggatttcattaaaaatatcaatcaaaaataatggatttttttgattagttaatcgccccacggtaccaaaaattatcttatcattggttcgtaataatttcctcttcatcggattatatatatatttgttaatgtcgattgcattattaataaccttgaatttaggaccttgaactgccttttcgctgtataggtattctccagcttgtgtcgaacaagctaataaccagttatctttttccactatatatttttggcaaggtatacgaacagttttttttatttgtttttttataaaagaactgtattctattggagacttagtattatgtgaatgacctatacatatattttttttatggcacatgcatgtaatacaagtattcacaaacaaattacttgaattaatatgaataatatgatatctattatcttcaaagtatctgcgtaattcttttatcaaactgtaatactctttaaaaccgttattatttcgcttcatcacatgtaacgtagtaatctttgaatccctaagcactgaactgcccattttagatgccagcgaattttcaccgcaatataaaaaatcgaatctcaccttttcatgattcatatgtgaataaaacgaatataaaaaattggcaattccactaaatgttccatctcctattgttatttgaagtactctaactggccattccataaattatttctcacctttcatacgttcccatcacatctataacagaatcataaagtgtatacctggggttccactttgtatgattcatgaacagacttgaatccattcctgaccaaagctcaatattttgtttttcaagttttatttctggaacaccatagcctaactgtatagcggcgcttgctataatattcgcaacctcaattaaattatatgtttttctattccaccctaaattataaactctatcccacccctccttactaaatagtaatgtaacgattccagcagcagcatctctagcgtcaataaaagaaaaaatttgttctccacctcttaaataaattgttccatttaaagcctgattacacaatgctttaataaaactgctgctttgtgctactttatccaatctaacattagtataatcctttactttcgaatcaaaaaaacacttattaaaaataatttctgtcgcatatttggccattgtataatggttgtctggcgctggacccataccttcatatcgtatttccttaactgaaccatatattccttgagttgaaacgtttataacacgttttacattcatgcataacaatcggtcaaatatctttaagctgtagtcaatactcgctgcaatttctttttcaggtctcagcctccgtgaaaatgcaagatgtatacacccatatatttcagaaacaatactactatttgaaaggaaatcctcatttgacaaaaaagtaatcctttcctttccagctatttcttcttgttccaacacagccttcaatctatcctctgatgatgcaatagctaaaatatcatagtctgttgtttttattaatattttgattattttcgcccccaacattccattagcgcccgtcaataatatctttttcatttaaaacattacactcctccatttcttaaaaatttgaaatattgttatgtatccgtattctgcatctttacaaacaatagtccagtttatgaagaacttcctgtgtatcatgaggtgttaaaattatgttgttcccatctaaatcataaattttatataattcattcaccttatcaattctttcaatcaattcctcttttgtatcagcatataaatgtattctggtagtatcttgtactaaagtacctgccgaatcttctggaattgtatcgccaactctatttcgtctcgcaatatgaattaaccaaggatagctctccaatgcttcaatccccccaaagccacctatagtagctcccggctgtcctaaaacattaagtgtcgcataccatcgcttaaatctagggttgaagtgtgttttctttcccatactacctgttaaagcaaattccatcaatctttcaaatgtattgaaatcattctcatactcaagaatttgatatgtcttacatccatttagtcttattcccgcctcatagcaaaaaagttcatctccgtttataatcgcctgtataaacaaggacccattttttatacctatttcttttaacatattgagaattatattgttatatttttgcaaaaatagtggtgtatagcgtgaaggataaatatataaatccggtgccttagtggcacttttttgtgtagtgttaaaatatctatcatgaatagccgctaattgtatatctccattctgggctatatatgtcaaattaatttcatcataaggaaggtactgttcaacaataacatcccctgattttgacaatctttttgccttttggaaacccttttctaattccactgcagaatagcaaggcgtaacgcctacagaacttgagccgtccacaggcttaataattacaggatagtctatatctgattctcgaatatcctttatactagtaataaaatattcctttggaacaggaacaccatattttatacacatttgcttaaaatattttttatttgtactcatccgaagctgattaactgtaaatggtactggtttctgaagtttatcaccaattctgctgacaaccggtcccaatcgctcattgaacgcagatataattccatcatatccttcatttataaaaagcttaactattgcgtcttcatcgactgcactaacatcatgtacataatccgccagcccttttacatacgtatttttattataatctgccacccctaccttcaccctattacgatgcgccaaatgaatcaaatcagctgtagtatttataccacctaataataatattttcttatcgcataaactaacatccaacattgttttcgaccgcccttccacgattatccttgccatttttttgacagcttatcaatctaactgatatatctcataccgctttgcatagtgcttaccataagtaatctttccaaagtcacaaatcttactgtccgctatcatcaatgcatttaatacaagattacaacctgccatacatgtaaacccacaaccagcagaaaaccttggatttatttcaataattttataacccatatttgtcaaaaaaaattcagcattaacaacgccatgtaaatttagacttaacattaaatcgttacatatagatttgagtatttcatcatttactatttccaccgcaataccacatccgttaccatttcgtagaagctcctttcgctggacctgctctttttgtcctgttgctgaatttctgatgaggtctactgtaaaaatagttccttcagtatacttctgaatcacataagcgttaggcttatatccagtacctgtaataaactcttctgccatcctttttgaatcaaatcttctacaatcattactagctcttccttcaacaggcttaatatagattggaaactcctcttcgggaatattttctaatctatcaaatgttttaatatacaattccggaaactctttatgtatgtaagatacaaatctatccttataatgacagcattccaccaggtcataatttggaatgcacaaacgcactcctatctcataaaataaatctctgtgatttgataggttaacaacctcttcatctattgttgggaaataaaaattcacctttttctttttacagaaatctagaacaaaacatacaaaacctttaaaattttctatcgcagaaggaaaactataaaattcatttacatcttttgcagttgcaacctcatttcgtggaaaaatatcagctcctataatgtagtattcattcgtctctttcaactttgaaataattgttgttgatgccattgtccctattgccgtaacgagaacaactgatttcatacaatgtctccattcactaaactattttcaatgctgcgggcataacgctctttgtatttattcatactaatggcaaaaccatctttatcataaccaataaaataactcacaccttgtcctttggcttgaccttctcgcttcttcaaatcgaaaaccatctttaccagcagacaacacattttaatatctgtcatgaagctcacattttcgatataccatatatcgttttcataagtgtgatggtatttacataaatcatcgtcagtaaccttaataacacgtggacattccaaaccaggcctcaatgctgtcctttgtttgtgtctatccgtcattctttcatatataaaaacaggtgatggtcttggacctataattgacatatcgccttttaacacgctccaaaagttaagaagctcatccaaagaatattttctcattatacgtccaaactttgtcacccgctgagatggtggaagcaaccttccattctcatcttttttttcattcatatttctaaacttaaccatgataaattgttttccatgtctgccaatgcgtgtctgtttataaaaaataggatgtcccacatcaaaaaatgtacagagagcaaagacaacattaagcggcaacaaaataattactaatggcaaagaaatcaaaatatctagaattcttttaatatatcgagtatacaaagtatctttaggacatacaggtcgtgctatctcattagcatgagagagattctctttacgaagatgttccacaatacactcttcttcaaatgaaaacaaatttttgtttccaactatcgtttcatcggatatcattttacaaccctttcttaccagtcattatttcgatatactgtttgaaatctctaatatattcagtttggtcataatgctcactacataataccagtaaaaccgaatcttcactgaaatcatacatttccttccaaagcatattgggaagatataagcctatatagggtctgttaagataatggactatttcattacccttaccatccataatcctaactttactggttcctgccacgtttattagaacaaattctgtttttagatttgcatgctgacctcgtacaacatcgtctgacgaaccatagataaagaagattcttttgatatcgaaaggaacatcataatttccctcagcaataaccatgttccctctaaggtcaccttttttcgtaaattcaagcattttcacctgacttaagattgtttctttctccattctcaaaatgcccccttaaccaatttttaactatgagaatctatttatcacctctataactgtctgaatttcattatcagtcattccattatatagaggtaaacttaaaacttcctttgcatatcgttctgttatcggataatccccctctttaaaccccaagtatctataacattcttgcatatgcggtggtattggatagtgaatgattgcgcctattccttgtgacgcgagtaaacatcttaattcgtctcttttttcacaatgaattacatattgatgataaacatgtgttgcaccagttcttacttcaggttttttaatcaatgcattcgttattccttcattgtacttcttagctatattcttacgttctgtagttaactcttctaagtgtgagagttttatgcgtaacaaaccagcttgtatctcgtctagtcgagaattgtaacctatgtatttattgtaatagcgtttctcgcttccgtaattccgaagaattctaacctcatcagccaaatcagcatcattcgtaattatcgctcctccatctccaaacgcccccaaattctttgatggataaaatgaaaaacatccaaaatcgccaaatgtacctgtttgtctctcttcccacatcgcaccatgtgactgtgcacaatcttcaaccaccctcaaattatattttttagccactttcattatagaagtcatattgcttgcctgcccatataaatgcactacaagaatagctttggttctatctgtaattgcagattccagccttgaggcatcaattaagtcgtattcatccggttcaataaatactggtgttgcaccgttcatggtaattcccataatgcttgcgatatatgtatttccctggactaatacttcatcttccggaccaatctttaaagccctaaaagcaatctgtaacgcatcaagaccgctcgccaaacctctacagtatctagcattagcataagcagcaaattcattttcgaatgcttctacctgttttcctagtacataccagccagattgaagtacctcaattgccttcgcctcatattcttccctatacttttcataccctctatcaagtcgttgctgtggaatattcatactaattctcccttttctttggtcgttttaaaacacatgaaataagcattctattttgggcttaaaatatttttctgccatctgtacaaaattgaagatttgttggacttcctccaattcactacgcacagcagaaacttgtaagttatctttatttattatttttctccatgcatctttctgtaaagaccgggggcgcggccttcgccatctattacccccggccagcatttagttaatgctgctacttatacaccaccgataacgtcccagaccccggaacacttacagccaccgtcttagtaaccgggtccaccttgacagccggaatcaactgccactgccctgtcgcattgttatagaacaataactgtacgttactgatatttgcaaccagatttggcacatacagggaaacctctacaggacctgtcttaacagcgcctgtagcagcatcctttgtaatgattgcgtgtgttcctgtcaaggcattaaagcccgtcaggtccacgccctgtacaacctcatttaacggctttcctgcattgatatcattaatagctgataccacatctgaaggaagacctgcggttgctgcctcactgtctgcaaatgcaacagcagtatcgccgataacagcctctcccttggaattggttgttacctgctgtcctgtggttgttactgtgtctactgcaacgccaattgtgctgccggttgggcttgcactggttgttgcacctgtagtcttgacgccagtagctgacacagttactgtggtgttggactttgagcttgtagtgctcttgttgctgctggacgagccgatggaaccactgccatcgcttccgctggatgaacttatggaaccattgctggacgcactgcctgccgcgaacgcccatacaggctgtgaagccaaagcaactgccagcactaaagctgctatgcatttctttttcatatccttcacctctcctttctctcctaagagtagttatattcaataaacagcatggtttcatgctggatattgcatgtttacacacactggctgccagatgccgcccattttccttccgaacaccggatactgcggcgtttcatccccgcttacccaatctcccggtaaaataattccagcagtatgggtatcagtgcttcccggtccgcataaaattcatcaaaccgaagggttaccacaccttccccgggaaccgtgtagaaatcctcatcccccagttttccccccgccactgcgtccatggcaactttcagatactggtccttagtcatattagtgaccatgtattcctgaatcctatcaaacagccttaccaccaggccgctgtcctgagccgaatgcttctggacagcctggaaaaacccttttatatactgttgctgctggtccatacgatacaatgctgagtgttccacattcgtatcccggtagcggacaaacacttccgcctgcttccctttcagtgttacagtttccccctttgccagagctgggtcccgtgtttccattccacctgtctcaatggttacggtgactccccctatttcatcattcagcacagggatgacactggtatcagctgccatataccattctatctctaatcctcccattaattctgatactgcgtccaccatatattgacagcttttctctctcccatcaccataagcataagccagcgtcaggtgctgcacatctttccccagctcatttcccctcaaatcagtaagcataatatcagtcattgtatcccggggtatcatcaatatctttatggtattcctcgccgtatcctgggctataagaaataacccgtccgcctgtccgccaaatcccgtggtggtcttctcggtcatctctcccgaccggtccacgccaatacacaggatggccttcacatagctgttgcgtctgtactgttttccgtcatattcaaccacgtccctgtcaaagagacattcgtcccattgcccgctgacctgcctgttgtcctgactgttatcctgaccattttcctgactgcttccctgaccatttcccaggtctgcataattcctggctgcaatctccgcttcaaggattttcctgttccggtacagattcatccccgtccatatgaaacaagtcagtgaaattgctgctgcccccacagcagccctgcacagtgcccgcttatggtttcgaaaccaactcatacctctgccttctcgtacctgtcatatttaccgtaatgaccgtatttggaatatttcccgtatttgccatagcgcccatagtatttgctgtaatatccgttgcgttccatgctcaccttgttaagcacaaccccaagaattcggcatccgcttttttccagctgccccttaaccctctgctccagacggtagcttatggacccgctctcaactaccatcaccgctccgtcacattggcgggccacgattgccccatctatcaggttggccataggaggcgtgtcaatgatgacatagtcatacagctcccgcagcttgcatatcatatctccaaataagctttcttccaaaagttccgccggattgggcgaatagggtcctgcaaatataatgctgagattttctatatttgtatcataaagaacatgctccagagaccgctgtccgcttaagtactgtgacagaccggccacctcccgttccagctgataacgggaaaccagaacggatttgcggatgtcagcatctatcatcactactctctttccaatctgggacagagaggatgccagggcaaatgtgatatcactttttccttcatcaggaagagagctggtcagcataattgtcttgatgccgtttccgcagaactgtatattggtcctcaatgtcttgatggcttcattatagtgatagtcatccttcatctccctgtttaatgcaacaaactgtctcatgacacatggcctccccttttcttctttctggatttccctactgtcggcttattccttgatttagaggaaatcatggcctccttatcctcaggcttttccccctcccgttccggtacagatgccaggacagataacccaaggtactttgtaacatcttcctcagtgcggattgtatcattcataaccacattcacagtgataacgccgcatacaagtacggctcccagcagaccgccaatcaaagcattctttacgttgctgggacttgatttgagtatgggaacctcaccctcttcaatcagtttaggaggcaccatctccataatatccccaatataatcagaggatgtggttgcaatcttgtctgcgattagctttgccatggctgggtccgggtcctccacagagatggaaaggattcgtgtgtcctgaggattgtcaatggtgactttttctactaaatctttatatgtaaggtccagttccatatcttcaatgacctggcccagaacccttctgcttgtcacgatgattttataatccttggtcagctggcttcctatctgaaggtcagccagtgatgtcagcgtggtttcttttgagagaatataaaccattgcagtggacttatactgcggggtaagtacaaatgcgctgaatgcgcctgccactcctccaaacaatataatggttcccaatataaaccatatcttgcgccggaactcccccagcaattccaagaggtctatctcaatctcgttgtcatcatacgtcttttccatgcgtcttcctgttctcctgttttcttaatcatgttatcttaccgtgctatcttttcagtattcgtactatctttttagtattattttcttcgcattcccccgcagcaggctgtggagcctgcgcccctccagatgtctgaccaaccagcgaaagctctcctcaatatccggctttctatagtccatacggtgcatatcagttcccaggcaaaaaattctgccctccataacctgtctcctgcaccagcggacctctttatcccatataccctttccattcagactgctaaaattcatctgcagcctgcagtcgcattgtgccaattccgacaggttggccccttctctcagacattcataacgttccacatgggctataattggtatatatctggccatggtcagtttccttattgcctggtacatcttctcatagggcacctgggggtcaaattccaccagcacatattggctttcctctaaagtaagggccttccctgtcctgagatggtccaccaatccttcgtgataataggtctcctgtcccaggcccgtcatgaaatccggcgcgattttctgtgcttcctccttcagacgttccgacagttcatacagattggaaggtaaaccgcgcctggagtagtgaggtgtggctaatatgtaccggattccctgcctgtaggattcttccagcatcctcctgctctcatcccaatccctggaaccgtcatcaattcccggaaggatatgtgcatgcatatcaatgattcccgtcatatcatcaccccattatatttccggtacaggtttttcagatagggcatcatgtcctcagcccatatatattcaggcatatagcttccggaaaacagtgtgatatactccggatttcccttgatgaattcataaaaatcacaggcaaactgctctgtatccaccgcatagctgcctcgtttttttatcagtattttctcaattccatattccatcagactcattcgaagacgataatatacaacccttaaattgtttttcgccgtgctctctttaatgttttcatacagcagatacgtcatctgggataaggaaacactgcttccacgtttttcgaccatgattgcaagcatctcttttgctttgctgctgggaaaataaaccattttaccgtttacataaacatcaaatccgtcaaaggtctttataaatatagttgcattctccgtttctgccatcagcgttatttctcccgttatttcaagccgcataccactgttctttgtaaggatataccactcaattgctttcaaattcgttacaaaaccgtttcaatatgtaataaaatgggatttttgtcattttatgtataattttcatatattttagcaatctataaattgcataaaactaacgccagtctcatgacgttaccagacatgcaggcagaattatatgaatcatttaataacaaaggatatataacatgaacaggaaaccaggaataaaattcaaaaaaccacataatccaaattatgtggtttatcttagatgtgtttaaacctcaatatgcttttccttaatttgttccattcttgacagaatcaatctccatgccatctccatacatcagtctctccccatgtacacagtcaccccatacactgaaatctaagtttcatgtgttgaatcatcatatcattattaccaattcctgccaatctgaggggggacacaaaccccggaagaatgcatttataccgtcatatcatgaaactggtcatatgatttcatttaatacaacaaaaaagaggcatccattacggaacacctctttctgaatactggtcaaccactcttatttaaatttatcccccgattccccttcatcaaaataatcccttatcaaattcgacagcgtaacctctgcccagctatactccggcatatactccccaacaaaaaagttagacgcccccttgacctgccggaccatatcgtagctgtcgcagaccactgcttccttattaacggcataggttcccctgccctttacaacgattttctcaatcccatatttcttcagggtctgcttcagtctatgccacgctaaatggaccgcctgcttggctgcagtctcatcccgttctccttcatttaaaatttcagccaggtgagataatgttacttccttaccgctccagtccacaagtactgcgagaagttctttggctttgctgctggaaaagtatatcagctcacctttataatacaaatcaaacccaccaaaggtttttacatataccttatccgacgttatatcaaacatgactcatgctcacctatcatcccatattcaaagagaatcaccttctctttgtctcctccgcaaccatcagggcctacctatatgttaacataaatgtcattgcaagaccagttgtatacatactaaaatgcaaataatgcccctcctattttacctaaaatacgtaaattttcaactggtttattttatttacttttttaatccgttcttccaaggtttgtaacccgccatagtaaaaagaaaggccccgttcaatccccggagcctctcttttcactatggtctttggtatcttatcctaaaacccttatatatccaggtgctgaccgcagcttcctcagggctgccgccttcaccacacctgcgttttaatgccttctttgcgttccggatacatccccccttatttccccactaccttatacgtctcctccacaatccgttccatggcgttaaggatgttttcatatcccgtgcacctgcacagatgtccggatatgagcttgcgcagttcatcgcggttataccgctttccggtacctacaatctccaccgctgtcatgattaatcccggcgtacagaagccgcactgtacggctgcttcctcgataaatgccttctggatgggactcagttcgccgtttggcccctttaacccttccacggtcatgatactgcggccttccgcccacatggtcaggtagatgcagctgtctatggcctctccgtccaccagcaccgtgcaggcgccgcactctcctacttcacagccctttttcacgctggtcagccccagacggttccgcagggtttccagtagggattctcttgggtccactgccaactccacttcttttccattaacagtcatatgcacaatattaagcatcccactcacctcctgcattgattacggcctgccttacggcacgtctgcccagctcttccaccagctgaagccggaactccttggaagccctccagctggaacgaggatttacttcctccagagcaccctttcccacagcctgggccagggcctcccctgtctccattccctttacagcctcctctgtcttatgacagcggattggggtgggcgcagccacgccgtatcccagacggatatcctggatgtgtttcttatcctctgacagcttcacgctgacagcgcatcccagggtggcaatctccatggcgttcctcttgccatatttaatgtaatgtccgccgtagccctggtagttctctttctttatccggatggccgtcagaacttcgtcatggttcctcacagtccttcccggtcctgtgtaccactggctgatgggcacctccctgacgccgtccggccccttaaggaccaaaaccgcgtccagacagcacaggctgctggcactgtcggcgctggtcacgccattgcacacattgccgccaatggtcccgatattgcgcagctggggaccgcctgccatatccactgcatctcccagcatgggaatgtgcttctgtatgatgctgttattggttatatgggaaaatgtggtggccgggccaatgacaatggttccgtcctcctccattcttatgccttccagttccttaattccgtgaatgcttaccagggaacagcctgccagctttccttccctgatttttatcagcacatcgctgcctccggagatgaccactgcctcagggtcttccactagggcgcgcaccgcatcttccacatctgctgcctgataaaatttttctatatcatacatgctgtttcaccgccctttctatattaatcctgcttctttgaaatgcttcaccatcttctgcgggtccatgggcagactgtccactgccacgcctgtggcgttcagcacagcgttgcgcacagccggcgcaactggtatggccggcggctcgccaagcgccttgtttccaaagggacctgtggggtcgtctaactctacaaaaagcgcgtttaaatccggcgtatccatagctgtcggaagcttatagtccagcaggttatcgtttaagggtcttccctttgcatcaaagagcagttcctcgctgaggccgtatcccagacccatgctcatgccgccgtgtacctgggcggctgccagcttggggttaatcagttttccgctgtcgtgtacattgactatgttggtcaccttcaccttgcccaaaggcatatccacttccacctccgcgaagcagactccggtggcaaatgtattgattttgcaatggctggtggcctctgccgtaatatgtacagagcggtccaggctgtaaaatgccgtggtggccagctcctccatgggaagcagctgctttccggtctccttatccacaatgtggttatcctccacatccagagtatcctggggcatcttcagcatatatgcagcgtaatccagtatcttttccttaaatatagcgcctgtttttttcactgccatgccgctgacataggtctgtctggaagcataagcgccggtgtcaaagggacttacgtccgtatcctgggtggacagaatatttaccttgtcctccgtaatgcccgttacctccgctgccatctgggtgaacacggtatcagcgccctggccgatttccgttgcgcccatctgcagctgcatggagccgtcctggttcaatatcatgcggcaggccgctgtttccagggatatgggatatacgcctgtcttataacaaaaaattgccattccgattcccttgcgcacagttcctgtctggttctcatattccttccgtttctcatcccaatggatgaattcccgtcccttttccatgcattctgccagtccgtatgtattgcatttcacatgggtgtgagggtcttcgtaacccggcctcatacagttcttctttctgaattccagagggtccatgccgagggccagagccaggtcgtctgccatgcattctgccgcgaacgcagcctgggggattccatatcccctcatggcgcctcctgtggccaggttggtgtacacggtccaggcatcggattccagcaccttttcatccttgtaaatctgcttgaattcattggatgagttggctacaatggcatgggcatgggatgcatacccgccctggttggaatatgcctccagtttcctggcgaccagggtgccgtccttcctggcagctgcctttaccttgaattcaatggcgtggcgcactctggtgcagcccagggtttcttccctggatatctccatccttacgccccgtcctcccacctgggtggtaaggaatgcatttaagggctcgtagagcacatcctgcttgttgccgaagcctccgccgatatagggcttaatgacacggatacggcccatgggaagtcccagcgcctggctgataacacgccgcacaatatggggtatctgggtagaggttgtgacaataattcttcccttttccatataggcaaatgaaatgggcgtctctatatggcagtgctgtacgctctgggtccggtagtccttctctatctccaccagctcctccgccttcactgcttccccataggtcccctggcccaccacaaaggaggaatgggcaatgacatttcccggcttttcatcgtgaagctgtgcagccccctctgccatggcatcctccacagtcagcaggggggcgtattcctcatactccaccttcaccagcctggctgccctggctgccgcgatttcatcctctgctatgacagcggcaatatcatcgccgtaaacccgcacccttgtattgagcagtttcctgtccgcaatatcctgatgggccgtttccacggaccatggatggccgggggtggggaactggatatccggtacatcgaagcaggtgactatcttcactacccccggcaccttctgtgcttcttccaaatcaaagctttttaccacgccgttggcgatggtgctgcgtataacctttgccaccagaagtccctggggctctaaatcggctgtatacctggcactgcctgtgaccttatcaaatgcgtcaacgcgggtcatgtttttaccaattcccatggtgtgctctacctccttatcttgaatgcgcaaacgcctgtataccaggcgtctgcattatatatgtgacacgttttaaattaatacatatttaagaacaaacagtactgccagaatgtacatcagaaggctgattttcttctcctttgcatggcctgttgccacattgataaccacgtaggagataacgcccattgcgataccttcggaaatgctgtacatgaaaggcatggcgatgatagcgatgtagcttgggattgcctctgtaaagtcgttgaagtcaatcttcaggatggagctaatcatcaggaaacctacgataatcagagccggagccgttgcaaaggacggaatggctaagaaaatcggtgacaggaacagggacagtccgaagaaaatagctgccactacggctgtaaggcctgttcttccgccttcagcaacgccggaagcgctctcaacgaatgtggtggtggtagaggtaccgaatacagcgcccagggaggtaccgacggcatcagacagaagagcgcctctgatattaggaagctttccgtccttatccagcatattggccttggatgcaacgccaatcagtgttcccagggtatcgaacatatccacaaacaggaatgcaaacatgatggttacgaagtttaaggacaggatgccgctgaaatccatcttaaagaaggtgggagccatgctctggataccgaaaccgctggagaaatcaggcagtacgctgaacattcccagctctgcatttggctggtacagcccggtcacttcgcagataatacccaaaatccatgtgatgagaataccccagaggatgtttccctttacgttcttaacaaccaggataccggtgataaggacaccaaccagggccagcaatacagtgattccaaccgagttaaatgttcctgcttccagagagcctttgaatgaaaatacagatacaagagtggcgctctccaccacgattttagcgttctgcaaaccgatgaatgcaatgaaaagtccgatacctgcggatactgcatgtttcagattcatgggaatggcgttgaaaatggcttcacgcacattggtaagggacagtgcaatgaagataagaccttccacgaatacggctgccagagccatctgccaggtataacccatctggagtactacggtgtaagcaaagtaagcattcagtcccatgccgggcgccagcacaaagggataattggcaaatgcggccatcagcagggtggcaaccagggatgcaagggcggtggctgtaaagacagcacctctgtccattcccgtggcgctcaggatgttcgggttcactgcaaggatataggccattgtcatgaatgtagtaataccggcaatgatttctgtcttgacatctgtgtgattttccgataggtgaaatactttttccaggaatccctgatttgatttgttctccatacttcatacctccttgaattcttacctatagttttccgctgtttctatttaaaagaacggtacccctttccgttccttttgtacttattcagttttcatttaaaacatgtaccgttatatgttccattaaaatattttgtttccggccacatacttggcgtcaatgtggcgctcatccgacagatagataaaccgctccagccgttccttcaggctcagaggctgaggatgcttaaggctttcgtcgttcagcaccagtacatccatctcatagccttcctcaaaacttccggcctttccgaagaacccgcctccgccttttgttcccaggtaaaatgcctcctccgccgtaaggggcttcagtgtttcatccaccagcctccagcgcagctttgacacctggatggcgtcggccatggccctgaatacggactctcccgcacctccggccacatcggttcccagtcctgtggggattccctgctccagatatgccctgacaggcgcaatgcccgaggacaggttggtgttggactgcggacaatgggccacgtatacgccgttgtccctcatcctccggatttcctgttccggcggccatacgcagtgagccataatggtcttcacgccattgccgaacatgccgaaatggtcatatgcgtcgccgtaaaactcagaccacgggcacagttccttcacccagtcaatctctcccttgttttccgacagatgggactggaccggaagttcatactcaatctgaatcttcctgagctcttccatcaatgtgtcggagcaggtgggaatgaaccttggcgtaaggatgggaaccgtgttcctgtaccttccctttatgtcctccagccactgcctggtttccctcagggattcctctgtctcctccaccaggatatccgggctgttccggtccatgttgaccttgcctaccatggtcttaagtccggtgtcctccatcaaatccatgagaagctccgtggcctccctgtgcatggttgcaaatatacaagcccttgtggttgcactgtgtttcatgttttccgcaaatatggtatatgccttcctggcgtactccatatcgctgtacttggcctcttcaggaaatgtccgcgtgttcagccattccaacagttcaaggtccatacctagtcccctgaatgaatactgcggggcatggagatgaaggtccgtaagacccggcacaatcagcctgtctccataatccgtcagaggaaatcctgcatacatctgcggaagctctttgtacacgccggctgatttgccatccgtacataccagatatccctgctccacacatatcagtgtgcgggaatcctggctgtagcagatattgccttttaatacaaaattctctgccatatgctcctccttttccgtgatacgccggtaaccggcgcatccttgtattcacccgtacagcggcgggcccgggctttcatatgcatttttgcacacaaaaaaaccaccgctgttcctaaggctccacatcagcctgtctccggcgccccgggcagtacctgatgtgaaaacttatagtcaactattacggtagttggtagaaacgctcaacctatcttgagcatatataagttttgaatacttatacgtctattcaattgtgtcatcttctgacatcttgagtctatcacattagacaacttaatgtcaatatatcttgtgctttttgtgcattttctacattttgtctaaatattttggcagatatatgaaatccctcccttttctttgtgcgaaaccaatattctttcaaaaatataacggtgcagtctgatgcaggattctaatataggatattctgttccgggaaattcagcccctgagaagcagcgctgaaaaaatgccctggaaaccgctgaaagccgcagctattccaaggcattttttcacgcaaacaataccgcaccatttccctctaccggaccaaatcatctgccagacccttaatcttctcccgttccccaatcacaatcacggtgtcatcatcctggaacacatagtccgggctgacatcggtggtcagccatccgcctctggtaatggcgatgatgttaatgccataccggttcctcagctgggcgtcccgcacagactggcctgtgagctttctggtggtctttatttcggatatatccacattctggtccagctcaaagagattgaatatgcgcttagagataagcctccttgccagacggaccgccatatccttttccggatataccacctgggctccgattttctccagaatttctccctgttccggactgttggccttggccaccacctgaggcacgcccagattgattacattgagagtggtgaggatactcacatccaccttatcgccaatgcagaccaccaccacatcgcagttttgtattcctgtctcccgaagcgtctccttctgcaaatcctttaccacatacgcgtgttccgtataagtcctggcctgccgtatcttttcctcgctgcggtccagcaccataagctccttatccgcctctgccagggttgacgccagggcgcttccaaaccgtcccagacctatgattccataggacattgcctctgtctgttttcgtgccatactaaaacctcctctatccattcaaaatgtgcttattatttaatttcataaatgtttaaaatgctttgtcaggtatgccatcccatacctgtcaaagctccgcttttatccgatggaaatgcttccctctgcataggaaactgatttcgtgggcttgaatacccagattgttacgatggttaatggtcccagtctgccgatatacatcaccagtacctccagaagcttgctgagggagctgagtcccggcgttatgccggtggacaggcccacggtgccgaaggcggacgtgatttcaaacaggatatcctcaaagggaatggccggttccaggatacacatgaaaaaggttccaagacacaccaccagggccgacagggccgtcacaatggcggccttgtaaaatgcctcctggggaatccggtaatggaaggcatgcggctcctcattgcaggccgcgccttttatagtgtgaaacagggtaaacagtgtgctggtcttgataccgccgcccgtggaacccggcgaagctccgatgaacatgagcagggccacggtcagcagaccggctgaggtaaattctcccaggggaaaggtggaaaagccggctgtcctggcagatacactggtaaagaatgcgcccagccatgtgatgtcctctgtcagccaaatcaggattgtcccggataccagaagaatcagggtggtcacaatcactgccttggagtggagacacagcttcttaaaggaccggttcttcaccaggtccatgattaccagaaatcccaggcctccgaatataatcagtccggctgtggtcagattcagcagcacattgtcctgatatcccgtcagattcttcagccctcccaggatgtcaaagcctgaattgttaaatgcagccacagagtggaacagactgattcccagggccttaaaaggcggataatccctggaaaataccaggaagctgaggactgcccccaccccctcaaaacaaagagtggtcatcagtacgtttctcaccaggcagacgattcccctgcccgaatccaggttaagtgcttcctttaccagaagccgttcctttaaattcaccctcctgccaagggccagaatcacacccacgcccacagaggtcacccccagcccgccaatctgaatcagcagggctaccacggtctggcccagagccgtgtaggtatcggctgtatccacggcaatcaggccagtgacgcacacagcgctggtggatgtaaacagggcatccacataatgaagctttactcccggctttacgcacaccggcagcatcagtaaaaaagaacctgtaaggataacagccaggaaaccaatggcaatgattctggccggagactgcctttccagatacttcatgtaatcacctcctagtgccttcagcttaccactaagggcataaagcaggtataacggaaccagctccggtataaagattatgtaaagattctataaagatacagtcatttatttcaaagatatggtatactgtccaggtagacaatgaaggaggtttttcaatccatgacccgttcccgcattcttgacatcctaaagaccgcagcagttctggccgcagccactgccatcggattcctgctggaatccctgggcctgtcccaggccaatatcattaccgtatatattctgggagtcctggtggtggcggcagtcacagccagccgctggtacagcatcagcgcatccctggccagcgtactgctgttcaattacatatttacagagcccatgttcgtcctgaaggcagaggacgccggcacccagctgaccctgctgattacgttcctggcagccgtattcaccagctcctacacggtgcagattaaggaaaaggccaggctttcccaacaggatgcctaccgctccagtgtaattctggacaccagccagctgctccagaaagcagccaccccggcagatatcctgtcctgcaccgcccggcagctgaacaagctgcttaagagggatatcacctgctttgaacaggatggcgccggacttaagtcccctctgtgtttccgtgagtactcatccccggtaacagggcgcggtccgtccccggacaccttagaggaactgaccgctgcccggagatgctttcaggaagggaaggaaacaggggcttccaccggtctgttcccctctgcagcctaccattttctgcctctccaaagctccggtgctgtttacggcgtcataggcatcctggcgggtgatacgcctcccggcgactttgaaaacagcatggccgtggccatcacaggccagtgctccatggcgctggaaaaagaatatatttccaggaagcgggaggaggaggcagccatggcccgggctgaacagctcagaagcaatctgctgcgctccatttcccacgacctgcgcacccctctcaccagcatttccggcaatgccggggtcctgatgagcgacggcgaaagccttgcagccgaacaccggaaccggatatacagggacatatacgatgattccatgtggcttatcaatctggtggaaaaccttttgtccatcacccgcatggaggggcagggcgtccacctgcacatggaaaccgagttgctggaggaagtcatagacgaagcaatgcgccatatcaaccggcgccacgaacaccacaccatcaaggtaaagcaggaaggggactatattctggccgacatggacgccaggctaatcatacaggtcataaccaacctggtggacaatgccgtcaagtacacgccggagggttccgtcatcacggtgaacagccgccaggagggcggctctgctgtcattgatgtcagtgacaacgggcccggaatccccgatgagtcaaaggaaaagatttttgagatgttctacaccaccggccacaaatccgcggacggaaagcgcggcatggggctgggactgcccctttgcagggctatactgagcgcccacaagggcaccatagaagtattggacaacaaacccgccggaagcattttccggcttatcttaccagccaaggaggtatccttacatgaataagccatccatcctgattatagaggatgacaaagcagtgaaaaacctcatcgccactaccctggaggtgcacgattaccattatacatgggcggataagggggaacagggcatactgaccgctgcctcccagagaccggacatcattctgctggatttggggcttccggatatggacggagtggatgtgattctcaaaatccgttcctggaccaatacccccatcattgtcatcagcgccagaagcgaggacagcgacaagatagctgccctggatgccggagccgacgactatctgaccaagccgttttccgtggatgaacttctggccagactccgttccacccagagacggttaagctacatgcagtccctggaggaggtgcagacatccctgtttaccaacggcgggctgaccattgactatgcggccggatgcgcctgcctggacggggaggagctgcacctgaccccctatgagtacaagctcctctgcctccttgcccacaatgcgggaaaggtcctgacccattcctacataaccagggaaatatggggcgctgcctgggaaggggacgttgcctccctccgcgtctttatggcctccctgcgcaagaagatagaaaaaaatccctcacagccccagtacatccagacccacgtgggagtggggtaccggatgctgaagcagtaagggattcttagaaccgcaatatcatttatgtcataaagccttttaaagcccagtcatatgtgtccatggcctgctggaagcccacgtctgcccgttccctggcagccgcggcatccatgtaggccgcttttgcctccagatattcctggcgtgacagcattcccagggccagcttgttggatgccgcctgaaatgcggcttcctgggacgccatagatgtagaagcgctggtccagagtgtctggctggccaggacttcctggtacagggtatccatctggccgtacattgcctcctcactctgatggatatccctctgacgggcgtggagttccttgttggagctggctcccccgctcctctgttccctcagggaataattgtttcccagtgcgcgccatttgtcggtgctgccgcccatttccaggacccggtccggctgcggcgcgggcatggggccaatttctgcctgggagccttccggatacccggtcaggataaacaattccttcttcacccgttccatctcatcccgtacagcctttgccttggcagccgctgcatcagcctccttacccgcctggtccgcctgggccccagaagcgcttcctgcctgtacctggcgctgcagcttctcatactggctctgtttccactcagcctgcgccaaggcagcctcctggtccgccttaagggtattgtaggtgcccatcaggttctgggccgtccagagcacggtgtcctccatcctgcgcagggacatggatgccgaactgccctgggccgaacgaatctgcttatccatatccttggcagcatcctccagtgtcttggcctgggcccggtactggctggcgccgtccatgtccccctccttctccaaatcctcagcttcttctctcagaagccgtctggtttccatgatatcctgcctggcgttctcataccgcgccagccggctgtcataccgggcctgttccatctgtatctggggactgtaggcttttaccagtgtctccagttcctcatagcggatgacgtccggcatttcctctgcacgaacctcaaggggatacatgcctgcaaggagaatgcagatgcagagcagaacacattttttcatcataccctatgccccctctgtctgtgcaaggccgttgaccgcccacctgtaatcctccagggcctgcctgtacttaagccctgctgtgtcgcatgcggactggctggcggccatggttccctgctgctgtgtgtattcatttttggaaatcatacccagactgtatttgcgctccgctgtaagagcgccggtgcgggccagctccagctcgcctgcagcctgttcatagtcagccctggcctgctccaacagcttatacctggcctccacatccgcctcaatctgcctgcgtcctgtctccaccttctgattcatcacatcccactgggttccgttccctgtaaacgtaagacggcgctcattggcagtctgggtgtagttctgttccagggccctttccttatccagctccaggtctatccggtccatttcatctgcatccggcacaggcacttccctgatatccggctgggcgtcgtggtcccatccggtcatgacgcacagctccctgcgcagtccgtcccgttccctgtcattggtcttaagggctgcctgggccgcctccatcttttcccgggccgccagcagctcagcctctgtggccatgccctgtcctgccttcactgccatggcttcatactttgacctggtctggttcacatcctcctccagggcagggcgcgccttggccttctgccagtaggatatcatctttgtctgggcatcttttacaaggacggcctcctgcctgtcatattccagctttttcacccgtccgtcctcgttctgggagtctgccagctcctggttctgttccgcctgaaggcgggcatttatggctcccaccgctgttcccgcatatgccggctggtcttcattgacactatccatcatcttgtcgctggaatcataaagcctgtcggcaatgtcctgataggcattcttcatttcatcatggtccttacccctgtattcatcgtattccaggcggttattaatgaccgtggcattgtactcatgtatcaggtcagccagttccccgtattccagcacatcgtccctcagcgcagcccatttttccgcagaataggcaaactccgggctggcccatgccgttgccggcccaagtatgcccggaaccggggccagcatcagggccaggcccacggctcctgcctttttccatgtaccgtttatccgtctcacttgctttcctcctgtctgattcttggtttccctggcgggatttggatttcccctgcttcggctccaggtttccgctgatgaaattcccgcctattcatagcgcagcgcatctatagggtctgcctttgccgccttggaggcagggtacagcccaaagaaaatgccgaccacggctgagaatgacaccgcgaccacaataacccctggttttatgacaactgcaaatcccagcagcagaccgcccagggatacggttcccactcccagtatgactccgatgatgccgccgcaggctgacaggatggccgattccgtcaaaaactggaccagcacatccccggtccttgcgcccagggctttccggataccgatttccctggtgcgctccgtcacggacaccagcatgatgttcatgatgccgatgccgcctaccagcagtgagatggctgcaatgccgcccactgccatggacaggttgcccatcatgctgtccaccgaggtcatttcctgcatggccgtgtacatgtacatatcctccggctccctgccgtgcatcttggccgcatacgccttaaactggctgaagaactggtccaggttcacatcgtcctttgcatacacatggagctggtaaaaatagtcattgggccaggtcagaagggtatagggtatgaaggccgaccccttgtcactgctgccgcccatcatcagggcctgaagggcgttttgttccttgcggtacacgcccaccaccgtaaagtcatcggtggagccatataaagtggtgcggaaggaccgtcccactgcattctcagtgccgaacagcatctgggcgctcttggtgtccatgaccacattctttcttctgcccaggatatccccctggttgaggtaacggccgtacaccacgttcaccggctggacgtcctggtaattgtagtcaattccctgataatcaaatttaatctttgtccgcttgtactccgcatcgctgctggtataggcgttgctgtctatataggcaatctggtccttaaaggcctccctggcccgttccatctcatccagggtaaaataatcgctctgccgcgtatcatccagccagtaaccaacggaaacataggcctgggtaatacccacgtccttatacaaatccgagaaaagcccccgcatggtatctccaatggatacaatggctatgacggaaccaatgccgataatgattcccagcatggtcagggcggaacgcatcttattggaacggatggctgaaaatgccattttcatattttcaatcagcatcctgctcccctcccttccccttctctgaggcgccgcgggctgcattcagcctgtcgctctgtatctgtccgtcgctgaaccgtatgatacggtgggcaaaggcagctatatcctcctcatgggtgaccagcaccacggtggccccttcctggtgaagcctggaaaacagctccatgatttccaccgaggatgcggtgtccaggtttcctgtgggctcgtctgccagaatcagaggcggttcattggccagggccctggctatggcgaccctctgcctctggcctccggacagctcgttgggcatgtgttccttccttgcccccagtcccacccgttccaaaagcatctgggccctggccgcccgtttggctttgggcaccctggcataggtcatgggaagctccacattctttagggccgatgtcctggatatcagattaaaggactggaatacaaaccctattttccggttcctgatatcggagagctgatccggcgtcatgtccgccacatcaatgccgtccaggtaatagtgtcccagggtaggacggtccagacacccaagtatattcatcagggtggactttccggacccggagtgtcccataatggccacaaactccccccgctcaatggtaaggtttatctttttaagtcccagtaccttgatggcgccggtatcatatatcttcaccaggttctccagcttaatcagaggtccgtcacagaccatttcctgcgtctgcctgtccctgtgcaaaaactttatccacttattcatacagcgcctcctgctactgggtaatcagcacggctgcgccgtccaccagatgcgggcccggattggtgataacctgcatcccttcttccagcaccgtatcgtccgtggggataacctccaccaccacgtcgccgtccacgcccgtggtcacaggtatacgtctgaccttcatatcctgcacaatggctatgtatgtcacttccccgtcgtcaaaaagtgccgatgaaggaaccgtgaacacatcctttgcctccctgattaaaagttccgcctttgccgtgattcctgcgatgagcttcgagcttccgccgtccacccgtatggtggtggggataacccgctccgtggagccgccgcccttttcctcgcctgtgggcgatatctttataacctggccttccgctgtctctccgtccaggatatctgctgtgatggtcgccatctgacctacctttaccttgccgatggaaaactcgcttaccttgatttccagttccagctgctccaggttctcgatgctgagaatgggcttatcatcctccaccttatccgcaaactgacccaccttggaattgacacggaccacggtgccgtcaatggtgctctttatctgggtattatccagttcttcttttttcttctccaggtcaaaggctgcgttctgtatctggataccgtaggacgcgtcagcaacaccacgcccgttttccaccgtgtagccctccatctgccttctggcgtcattcagtgcattggcgctggcttccagctccatctgggagatgtctcctgtggcaaaaagctggctgttcctgctgtggtccaggctggccttctggaaatcctggactgccttttcgtatcccagggctgcctctttatccttttcctgcttattagccaccgcaaggtcgtaggcgttctgggcaatctgcacctcccgttccaggtccgtgctgtccacaacagccagtacctgtccctttgtaacggtatccccttcctttacattcatggccgtgatttccgcatggatattggacaccacgtccacgctgtctgtgcctgatacaggaccgctgaccgtaagcttttcctgaatatcctgctttgaaagggacattacggcaaccggaattcccatctccttctttcccccggacatacgggagaaaccgaataaaaccactgccgccagtatcaggaccgtgattatcttccgcttccggctgaaccccttaaagcgccggacaggatgaaagcctccctccgatgccccgtttccggccttatgctttttcttctttttcttaccgtttccttccggctccggagccatcagctcctccacacggcggtcaatctcctctgcctccggcacgccctccaaaacctggacttcctcagaatcaccagcttttttctctgttcccatgactccctccttaatgcctgctcaaactgtattatttatattaatacagttatatcacacatggcatacttatacaacaaaaataaacaccaataccactgttgttcatttaataaggctattatagaggtttcccataaatatttcatccagtattttcataacatttcataaatgaaaacgaaagatttacttaaggatggaatccggccatggaaaaaaggcggccggaccctgtatcccaggtatttcctgccgcctttgacgggtgggacgtattcctccgccccagtctattcctcacaatgcaatctgtttcctgccatgcaatctattcttcccctgcaatctcattcttaccctgcaattgctgccctgaggcgtttcatcatctcgtccacatccgccctttcaatcaccaggggcggaacaaaacggatgatgttggccccggcgctgattaataccagcttctgctccaacaatgctttggacacaatggggcctgccggtaccgagaactccagtccctgaatcaatccccttccccggtgtcccctgatgcaatccagctcctctgccagctcctccagcttctcgtagagataggcgccaatctcctttacatggtccgtgatacggcgcttctcaaaaatatccagaaccgcgctggctcccgctgtcaccagtggattgccgccataggtggtgccgtggtcccccggcaccatggccccggctgcccggccccatgccaggaaggcgcctatgggcaggccgtttcccagggccttggccactgtcatcacatccggtttcacaccgtaatgctgccaggcaaacatttctccggaacggcccatgccgcactggatttcatccagtatcagcagcaggtcgtgttcatcgcacagggccctgacgccttttatgaattcctccgtagccggatagatgcctccctctccctggatggtttccataattaccgcacaggtcttgctgttaatcagcttttttacgctgtccaaatcattgaaatcagcaaagcggattcccggaacaaggggcttaaaaggctcctggtaatgggcattgcctgtaacggacagggctcccaggcttcttccgtggaaggaatgattcatggcaatgatttcccctgtcatgtccggctctgcatccccgcacccgtcgcagccgtctcccatggtttcatggagtttgttgtaatgatagcgctttgcaatcttaagagccccctcaatggcctcggtgccgctgttggtaaagaacaccttatccatctgggatgcctgaagcagcttttcacctgcatcaatagagggctggttgtagaacaggttggagatatgggtcagcctgtgcagctggtcctccactgcctttgtatactcctcatccccatatcccagcgccatgaccgcaatgcccgcgccaaaatccaggtactccctgccctctgtatcgtagagcttcactccctccccgtggtcaaacaccacagggaaccggttatataccttataaagggcctgttccgcccgttcaatcaactgtttctcagccatgataatacctctcgtcttcttgggaattatagatagcggttccaatacccttgtcggtaaagatttccagcagcagacagtgtgggatacggccgtccaggatatgcaccctggatacgccgttctttatggcattgatgcagttttgaagtttgggaagcattccgccgcccagcattccgctgtccacaaagctctgggcctcctccaccgtcatctcggatataagggaggacttatcctcgtagtccttatatacgccctccacatccgtgaggaaggccagcttttccgcctccacggccgtggcaatggcgcaggccgcgtcgtccgcattgatgttgtagctgaggaaatcctcatcaaagccaatggggcagataatgggcaggaaatccttttccagcaaatcataaatgattttgggattcacttcctccacgtcgcccacaaacccgatgtcctcgccgccggcatatttcttatggcatttaagcatcattccgtccttgccgctgattcccaccgccttgatgcccagctcattgaccagctgcaccaggctcttattcaccttattgagaaccatctcggcaatctccatggtaggttcatccgtgaccctgagaccgtttttaaactgggcctccatccccaccttgcccacccagcggctgatttccttcccgcctccgtgtacaataatgggcttaaagccaaccagcttaagcagtaccacatcctgaatcacctttttcttaagttcctcatccaccatggcgcttccgccgtatttcaccaccacgattttcctgttaaaacgctggatatagggcagtgcctcaatgagcaccgccgccttctgcataggttccaaattcattcacatactcctctcgttatgagcacttagcgcctgtcctttaggcgcttacgtgcgatacatgacgctggcacttagcgaggtcttccacgagcttagtgcagcggcccgttatgagcacttagcgcctgtcttttaggcgcttacgtgcgatacatgacgctggcactcagcgcccatattatgaacggtaatccgcattaatcctgacataatcaaaggtcaggtcgcagccccatgcagtggcatgggcgtcccccatcccgatatcggccacagcggtcacctccggctctgacagaatccgggtggcctgttcctcgctgtagtccacggccacgccgtcctttataatctgcatcttccctgccgcgctctcaaaatacaggtccactttttccgggtcaaactgtgcccctgagtagcccatggcgcagagtatcctgccccagttggcgtcatggccaaagatagctgccttggtaaggctggaacagattacagacttagccaggaccttagcctgttcctttgtctcagctcccaccacctttacctcaaacagcgcggtgcagccctcgccgtcgcccgccatttttttggccaatgtctcgttcacaatccttaatgcccggcagaaagtctggtaatcctcatcctttgttgtgatttccctgttgcctgccagcccgtttgccagaagaaggaccgtgtcattggtggaggtatccccgtccacggaaatcatgttgtatgtatcctggatgtcctggctcagggcctcctggagcaattccttgctgatggccgcatccgttgtcacaaagcttaacatggtgcacatgttggggtgaatcatgccggagcccttgcacatgccgcccatggtcacggtggctccccccagttcaaaccggacagccacctccttgttctttgtatccgttgtcatgatggccctggatgccttggttccgctctccaggctcttgtccagcagcggagccatggccatgactcccgccgtaatcctgtccatgggcagctgcatgccaatgactcccgtggatgccaccaggacgctttcagcgggaattcccagggcaagggccgccgcatcggctgtctgcccgcagtatcccatgccctcctctccggtgcaggcattggcaattcccgcgttaatgaccaccgcctgggcaggagccccgcttgtaacctggtttttatcccatttaacaggagctgccttcacaatattggtggtgaaggtgcctgccgacttacagggctcctggctgtaaatcattgccatgtcctgacggtccctgtatttgattccggctgccgcagaagcagcctggaagcccttggcagccgtgacgccgccggttataattttgattcccatacttgactcatccatctctctggttcctccatttatctccatacctttatgtcatatggcggtgcgccggcctatgtaccggtgcgccgccgtgttatcttaccgcacaaaacgggtgatgttttcctcattcagtatgaattcgtatgtattcacatcctcccgttcccgccacccgattccctgccagaaggcgtttcccacctcgttatccttaaatgcaatcaggctgattttgctgactccttccttctgcagggcctccatggcagtgcgcaccatacggtatccaacgccgtgcttcctgtatcccggcgccacgcacacgtgataaaaacagccggtcctgccgtcatggccgcagaggatgtttcctatgatatgtccgttctggacagccaccacgctggtagtgggattccttctgaggaagcgctccaccccctcccgggaatcgtcaatgcttctgattccaaagcccttgatttctgtccacaggtcgtaaacctggtcataatccgctatggtcatttcgcggataaggatatccatcgtacctgccatgttttcatgtttcctttctttttccctctgttattctctcaggggtgtccttaaaccagcctcccggaccatcaggggaacatgggaatctgcttcagtcccgtattctccggcaggccgaacatcaggttcatgttctggatggcctggcccgctgctcccttaaccatgttgtcaatggctcccatcatcaccacccggctggtcctggggtctatcttaaaattcacgtccgcaaaattacttccctccacccagcgggtctggggaaccacatccttatccaggacacggacaaaatattcatctgcataatatttgtcgtacacagcctttacctcctcgtaggacacttcccttgtaagggaggcgtaggctgtcaccaggatgccgcggttcatgggcaccaggtgaggggtaaagctgatggttaccggctttcccgccgcataggacagctgttcctcaatctccggcgtatgtctgtgggaggccacgccgtaagccttaatgttttcattgacctcacagtacaggctgtccaccttgctgcccctgcccgcgccggatgtaccggacttggcgtcgatgatgatggtatcagggtcaatgagcccttcctttaccaatggatatactgacaggaaggaacaggtggggaaacatcccggattggcaatgagcctggccttcttcaccttttcccggttgatttcaggcagtccgtaaacggcttcaccgatgaacccgggggatgcatgggtcagcttataccatttttcgtaaaccgacacatccttaatacggaaatcagcacttaaatcaatgacctttaccttagataatatgtcttcgtccaccagggatgcgcacaggccctggggcgttgcggtaaacaccacgtccacctggtctgccagcgccttcatattatcatccatacaagcattgtccacgatttggaacatgttctggtaaatggatgcatatttctggtctatgtagcttctggaaccataccatttaatctctatgtcatccctctggagcaggagccttgccagctctcctcccgcatatcctgtggaaccaatgatacctgccttaatcatatccatatctccttatatttataaatattggctgctgccttcattatagtcagtttttctttaaatgaaaagaagcatttccatgaaccttattttccggtccccttatggatttcataattatacattataaatgcataatatgcaacatcttttaaatatttttatttagtgcttgcattttatcacataatgttgtatatttatgaaagttcaatcagtacagcaatctcaggaggatattaatatgaaagaaaaagtagttttagcttattccggcggactggataccaccgcaatcattccgtggttaaaggagcattttggttatgaagtcatctgctgctgcattgactgcggccagggcagtgaattggacggcctggatgagagagccaaattatccggggcttccaaattatatattgaagatttagtggatgatttctgtgacaactacatcatgccctgtgtaaaggcaaatgcagtatatgaaaacaaatacctcttaggcacctccatggcccgtcctgccattgccaagagactggttgagattgcacgcaaggaaggcgcctcagccatctgccacggcgccaccggcaagggcaatgaccaaatccgctttgagctgggcatcaaggccctggctccggacatcaaaatcattgctccatggcgtatgaccgatgtatggaccatgcagtccagggaggatgagattgaatactgcaagcagcacggcattgacctgcccttctcagcagacagcagctacagccgcgacaggaacttatggcatatcagccatgaaggcctggagctggaggacccgtcacaggagcccaattacgagcacctgcttgtgcttggcgtaacgcctgaaaaggcgccggaccaaggcgagtacgtgaccatgacctttgagaaaggcgttcccaccagcgtgaacggacagaaaatgaaggtttccgatatcatccgcaagctaaatgagctgggcggaaaacacggcatcggcattgtggatatcgtggaaaaccgcgtggtgggcatgaagtcccgcggcgtgtatgagacgccaggcggaaccattcttatggaagcccaccagcagctggaagaacttgtattagaccgcgccaccatggagactaagaaaaccatggccgacaagatggcgcagattgtttacgagggcaagtggttcacgcctctgcgcgaggctgttcaggcatttgtggagtccacccaggaatatgtgacaggcgaagtgaaattcaaactgtataagggcaacatcatcaaggccggaaccacatccccatactccttatacagcgaatccctggcttccttcaccacaggcgacctgtatgaccatcatgacgcagacggcttcatcaccctgttcggactgccccttaaggtcagggccatgaaaatggctgaggtggaatccgccaaaaagggccagtaaatacggcgtaaacagaaaagaaatgccccggagaggttggatatttccagctccggggcatttttctttcctgcttctataaggtatttaaccgcattaatccagatgtatcctgtttttctccacatccagcccttccggcatattgataatccgaatccttccgtcggtggtaaccggctcaagcaccccgtttacactgtggctttctatataggcaatcacagcatcaataatattgggctggttcctggcccagtccgttatctgctggtactgctggtcataggcgtccgtgttcaggtcaaaaagccggcaggccgcctcattctccgggtcaaatgtctggtagacggcaatgccctggggaagcgcggcaggtttatccggcggaagtatggtgaatgcatcccagctgtcgctgccccccagctcataatcagtggtcgtgaccgtataccaggcctccgggtccaccggctctccgtttgacaggcgcacatcgctgatttcagcctttcccccatatgcattttcctccacaggctcataggtaatggtataggtaaagccggagggtatcaccatgccgccgaacacgccggactggtccgaccgcactgcgtcagtcaggttgttggtggaaagaatggatatcaggttggcgcccttgcagcgcacggtaataacatggttgttcagaccatagagcatggatgtggccaaatcagactctgttatctcccctgcctccagctccgctgtcagggtgcctgcattgatggctgccaggtctgcgcctgtgtactggcgcagggcatcggccagcaggttccccagggctgattcattggaacgtgaaaatatgcgcacataattgtacgccttatctgtttttcctatgacatggtccggcacctggtaacggttttttcctgtggtgcggtactcctccagtgcatccagcatcccttcggtgccgccgactttcatgtaggagctggctccctccagaccggcataatacttctggccgcacaggtaatggcgcagggcaaaggtaaacaaatctgaaccgtaaaactggtacgggttctttacaatggaattttccgtaaggcactggtaaaactcaggatgggtatcctgaaaataatcgtattttaatgtgtcatcccggcggtaataggtggttgcgcccaccggaaccgtagcactgtaatattccggcgcaaactccgtggaggccacatattccagatacaggcggcaggcctttaggacagcctcgtctgtgatgttcgcattgattcccaggtaccagtctccattggtggccagccagcggtcctcctttgtgcggcccatatagggtatgaatacaaaatcccgggcaggcacccatacctgcctgccgttcttttcaattttatagcttgggacaccgttcacatcctttattttttcctcaaaatgcattgcgtaatcaacgtagctcactgagcacatgactgcgtttccccgaaccacttcccgcaggttctgtttgctgctcatcaggaagtcgccgttctggtacagcccaaggccttccagctcctcaatccccctgagaacacgggcaaaggccggattttcaaaggatacctccgccggattattccggtaccggttcagccactgcacatattcactgtccgtgtaagcatccagcagaaagggcatggccaccactgccgcagcgtcattgtaaagcatcccgaacgcataggcccgcacccctgtctcctccctctgcgcctgaatctggcggcagagttccatgaactcctcctgggtccggggcatgctgtatcccaaatccgtcaacagctgctgattcaccatcagccctgagatgtatccgttgcccacaggcagcgcatacaccttcccccctacctctgcatcattcagggcgctaatcatgtaattcttcaaaaacggttccgatgtcaaatccttcagataaccgctctggacataggtataataatcctgtgtatagaggatttccggtccccctccgctgcgcacggctgacagctgggcattttccatcttaggtccgatttcataggtgctttctattttcacatccggcatggtgcggtggatatatgcctcagcctgctccgtattgatgttctcacccatggtattgtacacgtgaagcaccaccggctcctcagccggcgcagacccgctctgctgcttcttatcctctgtggccgcagtatcgcccggagccccgcatccggttgcagcccatatcagcagcagtcccagaagcagcccgattcccacctgtttcttcataatccttctccctctttcccgggtattttgtccatcgccatggcagcccagggacccatcccccatccggctccccaggccgccccttagcccagcaggccccgcagctcctccatattgattggctttgtcagaacagctccgaatcctgccctggctgcctccgcccgcacctcatcctcgctgctggatgtaaatgcaaagattggaatggttcccgcgctattcttgcggctgccccggatagctgccgctgcctcaaaaccgttcatgaccggcatatgcaaatccagcagaatggcgtcatatgtgccgtccatagcatcaacatatgcctccagggcctggcgtccgttctccacggcgtccacctgctggccgtccgcccgtatcagctccactgcaatttcccggttcagttcattgtcctctgccagcagcagccgcagacagcgtccctcgcgccgtacccgcgcaatctcctttgccaggattgtgaaatcaattggctttggaacaaagccgttcatccctgcctcaagagtctccctgcggtcctcctcaaaggcattggctgtcagtgcgataatgggtatggctgctgcctgcgggtggctgcttctccgtatcctgcgggctgcatccagccctcccagaacaggcatctgcaaatccatgagaatcacatcgtatgtatgctcaggagcttccagaaaacggctgcatccctcttccccgtccctggcggtatccacctctgctcccataagtcctgagagcatttccactgcgatttccagattgactgcattgtcctccaccaccagcagatgcatgccctttaatactccggccagcccgccggacgtgttctcgctctgccccagcattccggtgattttccggtacaggttcatcctgaacagcggcaggctgattgtatggttaaatcccttctgtctaagttcctcagacagttcctgctcatccggtttcagtcccagcagcaaaagggtgctgccgcccaaatcccgcctcagtccttctccggttaatgcctggtcaaaacgcagcatcttatagggaagaaataccagggaaaacggatgccctgccgcccttttcccggctgccagggacactgctgcctgatagtctgtcttccaggctccgtccacaccgatttcctccagctttctcactgcatcccggcattttacctcgctgcccggctcgccgataaccagcatggcgcagccggctgccagcggcacatggcggctgcccagacggatggaaagctcaatggtaaaggtggtgccctcacccggctcgctttccacgcggatggtgcctcccatcaggtccacaatgcgcttggtgatggccatgcccaggcccgtgccctggattccctggctgtaggaattctggtcccgcgagaacatatcgaaaatccggctcatatattccgggctcatacccacgcccgtatcgcttacctgaaacacgtagcgggcaaatgcaggctccggcgactgcacttccgtgatatccagacggatttccccgtccttcggcgtaaactttacggcattgcccagcacattggtaagcacctggcctaagcgcaccgtgtcgccgcacagcagttcatgggtgatattccagacattgacgtcaaaatgctggctgcgcacacttgtctgggactgggtcaccgtgaccacgccggacagccattcgcccagctcaaactcagtctcggccagctgcattttgccggattcaattttagacatatccagcacatcgttaatcagccccagcagcagcttggaggaattggcgattttctgaaggcattccgttaccttcttgctgtcctccggtgaatacagagccaggttggtcaggccgattacagcgttcaggggcgtacggatatcatggctcatgcttgccaggaacgtgctcttggcggcattggcccgcgcctcgctctccagcgcctcctccagacgcctgcgggactgtacccgttccgtgatatcctccagcgtcagggtgataaagcgctggctgctgtcctgttccgcaatcagataggcattaagggacagcacgatatccttgcgggtgtcggggcgggtaaagcgcagcttcaggctgccgctggcacactcccccttacggattcggctgataaggtccagaaccgcctggcggtcgctgtcattgatacagcataaaaacttttcttctatgacattttcaaatgcatcctcaatccccagaacctggtccgtattgcgggacgcatactcaatggccccgcttgtactgtctgcaatgacaatgacattgggcacataatgggtcataagggtgaaaatccggtcgcggcgcacagcttccctggatgcgttggcccgcaccacaaataccagcatgattactatcaccagaaacatacccagcatcagcgcaatgatgaacacggtcagatggatggtttcctggttaatctgcactgcatctgccgtaatgtggtcataggaaacacaggagataaaatcccatccggttcccggaaccggcgcatacacaagctcataccgggaatccccgaaataaatctcggcgctgccgcttttatcgttcctgaaatcccacagcaccctgtcacagtccgtcctgccctggtcatccggagtaaagaatcctgcatttttaggattttcctcaaaatatgtaaacagatttagggattcccccagctcctggtttacatgggtgcgggagagaatcagacccgaatcagtggtaatcatataggacgcattgtccccaaaggtggtggaatcatagagggaccggaaggaatcctggctgtagatgccaatcagtatgactgagcccgtacggcaggaaaatgcaaccacatccttgccggaagcgctgaacgggtctgatataaagctgattgcctccccgtccggactggtcaggcagtccacatatgcctggctggaatacaggttgatgggtttcacagccgttccctcgctgtacacgccgcggccggattcattcagcagcacacagtaatcgaatacggacaccctgttaaaatcccggatataactgcggtcctcctcactgagtccgtccatggagtcaaagccgttctccttcaaatcttcggacatgccgattcccagcacgcgtatctcatgctggcagtgattgaatccttctgttgttttggaaatcagggtattggttgtctccttcagcgcagagatattggaattaatgatacggtcatagatgtctctgcggtatccttccagaaaataagacaatgacaggtaaaatacaatcgcgagagcgatgcagaccgctatggtcgcaggcagagaaaacttatgtttttttcgtatctgtttcatctgccgtacctcgcttttccggaaaccacatgactttgaatagctttaactattattatattattgagcggcccatttgtcaatttcacaaaacagagcctcccgccggccgcatactgcttcatactgcataaaacggaaaacagacctgtgaagaaaaagcctgttctccacgggtctgtttttgctgctcttatatttctacagcgacttcacggctgccacaacattctcaaccgtaaatccgaatttcttaaagagctgtccggccggtgcgctggcgccaaagcctttcatggtcactgtggttccgtcaaggcccacatatctgccccagccgaaatcgcccagtgcctctactgcaactctctttctcactgcctttggaaggaccttctccttgtagtcctcaggctgctcctcgaatacatccatgctcggcatgctgacaacgcgtacatccacgccctcttttgccagttcagcctttgcacccactgccagttccacctcggaaccagtggcaatgatgatggcatccggaacttccttcgcggaatcctccaggatgtaggcgccctttaacgcctccttgctggagccggccagctggggcaggttctgccttgtgagcaccagggccgtgggcgtcttcctggaggacacggcgctgtaccatgcggctgctgtctccgtggcgtcggccggacggtatacatggaaattaggcatggcgcgcagcatggccagctgctcgataggctcatgggtaggtccgtcctctcccacgccgatgctgtcatgggtaaacacaaaggtaaggggcacgcccataagcgcggacagccttgccattggctttgtataatcactgaacacaaagaaggtggacacgaacgccctcaggccgccgtgaagcatgaggccgtttccgatggcggacatggccagctcgcgcacaccgaagtgcaggttgcgcccggcgtaattgtccttggagaaatctcccatgtcagccatgtaggtcttggtggacggagccaggtccgctgcgcctccaatcaggttgggcatcaggttcttaagcttctgaagctgcttgcccgacagacttctggttgcatccggcttgtcctcaaatgcccaatagtcttcgctgtcataaacatcatcagccagattcggattatagaatttatcccataattccttcatttccggatattttccgcagtattcggcaaataatgcattccatttttcctctgccccggcgcctctctcagcgtatgccttataattggcatatacctcatccggtacatagaacggctccatggacggccagttcaggaattccttcatggcctttacattgtcttcacccaggggctcgccgtgagcgctggccctgccctgcttggcgggacagccgtagccaatctgggtctttaccgtgataaaggacggacgggaggtatctgcctttgcctcctcaatggccttgccgatggcatccaggtcattgccgtcctcaactgtaatcagctggaatccgaaggcttccatgcgcttctgtacgttctctgtaaacgcgatatccgtgcttccctcaatggaaatacggttggaatcataaaatacaataagcttgcccagtcccagggtgcctgccagggagaatgcctcggaggaaattccctccatcatgcagccgtcgccgcccagcacataggtatagtggtcaacaacaggatatccgtccttattaaacacagctgccagatgggactcggccatagccatgcccactgccatgcccatacctgcgcccagcgggcctgtggtggcctcaacgcctgctgtatggccgtactccggatgtcccggtgtcagggaatccatctgacggaaattcatcatatcctcttttgtaaggccgtagccgaaaagatgaagcagggaatacagcaatgtggagccatggcctcctgaaaggataaaacggtccctgttctcccatcctggattctcaggattatggttcatatgttttgcccacagctcaaaggacatggctgcggctcccaaaggaagacctgggtggcctgatttggctttctgtacagcatctgctgccagaacgcggattgcattgactgacattgtatcaatctgattcatagttccctccattccggtgcccccaagggggcccacgcatcatagatgttatttttttaccaactgccctttattataccaattccatccatacagggcaatactttttctcgcaaaaatcagtgcaacattttgcgtttctatgcgttattttgcaaatttaaaaacaattgttataaaaagattataatttaaacacattttcatcacattttaattttaaaactgtttgatgaatatgtttataaaaaactgacaggaggacacaatcagtgattgaagtaaaaaatcttgtgaaagattacggcggccatctggcagtggaccatttaagtttccgggtggaagacggccagatatacggcttcctgggccccaacggcgccggcaagtccactaccatgaatatcatgaccggttatctgggcgccactgagggccaggtcttcatagacggccacgacatactggaggaaccagaagccgcaaaaaaacgcattgggtatctgccggagattccgcccctgtatatggacatgacagtgaatgaatacctggagtttgcggcctgtctgaaaaagcttcccaaagcagaacagaagggggctatacaggaggtaatggaactggtcaaaatcacggacgtccggaaacgcctgattcggaacctgtccaagggttaccgccagcgggtgggaatggcccaggctattttgggtaagccctctgtcattatcctggatgagcccaccgttggtctggaccccaaacaaatcatagagatacgggacatgattaagagcctgggcaagaaacacaccgttatcctgagttcccacatcctgtccgaggtgagcgctgtgtgcgaccatatcatgattattgccaatggaaagctgcttgccagcgatacccctgaaaacctggaacagcgtttaaaaggcgcggccgggctggagctggttgtaaaaggcagcagggaggcgctgcagcctgtgctggaggaaattcagggactggcggcagagagaattgagacgggaaatgaggacggcacctgtgttgtgaatctgcagtttaccggtgacagggcagcggaaacggatatccgcgaaaccattttttataccctggcccgccgccggcttcctattctgtccatggttccctccagagcatctcttgaggaaatattcctggaactgacagaggatttaacagaaaataccgaaaaccaggacagcattgccaccaacagctgcccagaccaatgaaagaaggaggattcccaatgagagccatctataagcgggagctgaaatcctatttctgctccatgacaggctacgtattcattgctttcatgaccacgttcatgggcatttatttcatggtttacaatatgattaacggttacccctatttttcttatacgcttaattccatactgatgatactgatgattgcggtgccgattctgaccatgcggagcatgtcggacgaacacaggacccggacagaccagctgctgctgacctccccggtatctgtgtggggtattgtcatgggaaaattcctttccatggtcactatttttgccataccaatggccattgcctgtctatgcccccttatcatccggagcgccgggaccgcttacctgaccgaagactatgcatccatactggtcttcttccttttgggatgtgtctatattgccatcgggcttttcatctcctcccttacggaaagccagctcatagccgcggcaggaaccttcggcatcctgctcctcagcattctctggccagggctcctgaacttcataccagtaagtgcagccggttctctggccggctttctcatcctgtggtccctggtatgtttcatcctgtaccggcttaccggccatattccgctttcactgggcctggaggcagccggagcagcagttcttgcgggaatctattttgtaaagcagagcctgtttgaacgggccctgaccggactactgggaaaaatcgtcctgacagacgtatttgacggcattgtaagcagccatatgctggatgtcagcggccttgtctattacctcagcgcagccggtatattgctgttcctgactgttcagtcaattgagaaaagaagatggagttgaatcatatgaccagaaaatgtaaaaaaggcagctatatggcattgttcacccttgtggtcattgccgctgtcattgtattgaacctgattgtgggaaagcttcctgccaaatatctgaagcgggacttaagctccggcaagattctcaccctgggggataccacccgtgacatcgccgcacagctggacagagatgtaaccatccacattgtggctgatcccaacacagtggatgagcggattacatcctttgtaaatctgtataaagacctctccccccgcatttcagtggagaacaacgacccggtgcttcacccggatgtgcttacctccctggacacggagccgggaagcctggttgtatcctgtgaatccaccgggaaaaagacctctgtttcgtttgatgatatcatccagtttgaccccatggtttactaccagtacgggcaaatcaaggagacagcctttgacggcgaagggcagattaccagcgccatccgctatgtcacaagcgatacggctgccgccgtatatgcactgaccgggcacggagaagccccgctcccctcagccgtaacagacgccatggacaaatccggcatgaacgtgactgagctgaacctgctcacccagggatttattcctcaggactgcagccttctcatcatgaacgcccccggtaaggacatatccgcggatgaaaaggaaatgctgaccgattacctgaaaaacggaggccgcatgatgcttctggcaggctgcacccaggataccctggtcaacctgactgaattctgctcccagtacggaatggatcttaaaaacggattcgtggcagacccggctccccagcatttttacaacaacaatccctttaatgtcattccggattatgattttgccagcagcctccttacgggaatcgattcctccgcggcagcccttctggttcagccctcgggcatgaccatacaggaaaatcccccggaggacattacagtccagcccttcctgaccacctcggactccgcgtttttggtggaccccgtcacccaggaaaagacccagggcgcctatgtgctgggagccactgccacggaaaccgtaaaccaggaagaggggaccgcctccatgcttaccgttatcacagcgcccggcatgattgatgactccatcctgtcacgtttccccagcatcaccaaccttcccctgttcataaatgccgctgccaacggactgcccggcgtaacacccctgtccattcccggcaaaagcctggatattacctataatatgataacatccgccggactgtggagcgcgctgttcatcatcgtcataccggtcgttttcctgattgcaggatttgtaatctggatgaagcgccggaagctttaagctgaggaggttatatcatgaagaaacatgtaaggccaatggttcccgctctgggagccctggtccttctctgcgccgcctatggcttcatcacctggcagcagggaaggagtgcaaaggcaaaagaacccggaccggaagacactgcggtatatatgaccgaccttccggggctctcggccctgtcctggaaaacagatgataaaagcctgtcctttacccaggaaaacggcacctggtactataaaggggatgatgactgccctatccgccaatatcccctgaccaccctggcagataccctgtcccacttaaaggcagagcggaagctggaaggcgcggattccccggagtcatatggtctggatcatccttccgtgaggtttgacaccgtatcctccgacggttcttcccgttccatcctgttgggcagccaggtcccggggaccggcagtgaaagcgcaggcaatgcccggacgcctgcccggtactatgccgctgtggaaggggacagccggatttatatcataggcagctatctggccgacacagcaggcaagggactttacgattttgtggaaacagaaacccttccccatgtgtcaggcgcggatatccgggaaataacaatatccagggatgggcagaccagccggttctgtaagaagacagcggacgattcaggcaataccgcctggtacaggaactcctgcgaagacgaggccagccgtctggatgacaacggcgcccttaataatcttgcggatgccataagcgggctgtccttccaatcctgtgtatcgtacaaggccagtgatgaagaattaggaagcttcggcctgtctgcgccgcagatgaccctttcatggacctatgaaagcggagacataaacggaactgtatcattgatgattggaagccccgatgaagatggaaagggctattataccagaaaagacgattcatatgccgttaacctgatatctaaggatgaagcagaacgttgtctgaacgctgtctatccatagtagtgtgaatcaaatacaaagttgcattaaattgcgaaagggaaacagcactgctattctgcctgctgtttcccttttcgctatcatatctattttatttcaattccggctctgaaatatatatatctatgccccttccttgcgctcccctgccccctggtcatggagcacaaagtggttcttctggaaatccagtatgccttccgcccgcatcttacccagctcactggacatggcgctccggtccacgcagagatattcagccagttcctggcggttatggggtatgtcgaaatcccttcccccttttgccatggcctgctccgacagataggacaggagcttttccctggtggttctgcggcacacatgctccagcttgttttccagcttgacattatgctccgacaccagacgcagcatgttgtgaatgaacctggtatgaaaatcacaggccaggggacagaatgtaatcatccgctggtaattgagaaacaatgcctcgcatccgccttccgccaccacgctcaccggcagtaccggcgtcctggcgcaggaataggactggccaaagagttccccttcctttatatggtatatgtgttcctgatgtccccagaagttttcctggacaacacatgcctttcccctcagcagtaccagcaccttattgaccgattcccccatgcggaagatgtactctccatcctcatagagcacctgctcagaggcacagcattttaacagggtatagagctcatcatcattgataccgtaaaatagcggagattttttcacaagaggcagccattcctccatattcgcccttctttccgttgcatttacaactcatttgctgtaaatattatatattcaagagatttttccgtcaagagggattttatgtgagattaaatctcattcattaccgctggctgtcatccatttccagctgctttttatatatcccaatgactttctgcatggcctcctgtccgggagctcctatggtaaggcgtttctccacgcaggttttcatgctgatggcctcatatacatcctcctcaaacaccggactgatggccttgtactcttccaggctgagattatccagggcaattcccttgtcaatgcatgtaaggaccagctgtcccacaatgccgtgtgcatccctgaaaggcactcccttgttcaccagataatccgctgcatccgtggcattggtaaagccgtttttagcactggcctccattacctcccggcggaagctcatggaggaaatcatgccagtaaacagggccaggcatccctttaccgtatcaatagcgtcaaaggtaagttccttatcctcctgcatgtccttattgtaagccaggggaatccccttcatcgtggtcagcatggacaccagggcgccgtatacacgcccgctcttgccgcgaatcagctccgcaatatccggattctttttctgcggcataatggaacttcccgtgctgtaggaatcatcaatctccacaaaccggtactcattggtattccatattatgatttcctcgcagaaccgggacaggtgcatggaaatggtggaaagggcactgagaagctcaatgaggtaatccctgtcagccactgaatccatggaattaagggttggcccgtcaaagcccagcagctgcgccgtgtattcccggtccagaggataggtggtgcctgccagtgcgcctgagcccagagggcagtaattcatgcgcctgcgtatatccttaaggcgtgaacggtccctggagaacatctcaaagtatgcccccatatggtgggccagggtaatgggctgggccttctgcagatgggtaaagccaggcataaaagtatctgtattcttttccatgactgtcagcagctcttccagcagttcttttaccagcgcttcaatggcgtcaatttcatccctggtatagagcttcatatccagagccacctggtcgttgcggctgcgccctgtatggaggcgctttcccgcttcgccaatccgttcagtcagggttccctccacaaaggagtggatatcctcatatccggaatcggatgatatagtcaacgtcccattatccaggtcttccagaatgctttccaatccgcggataatatcatctctgtcctgttccgtcagtattccctgctttgccagcatctttacatgggcaatgctgcccctgatatcctgacggtagaacttctggtcaaaggaaagggattcattaaaattgtgtaccagctgattggtttctttcgtaaaacgtccgccccataatttcatggctgttatctccttatttctgattttcttttgtcctgttttcctgtttgctgctttcttttttctgccgctttctattttccttatggctcttacttatgctgtatccgcttaacgcaccgctctttttcttcctccggctgattccggccagcaccgcggctcccaggacagctgcgctgattccggtaatccaggccccgtacttaaggccctccggttcataggaaaaactgattcggtgggttccttcgctgatatccactgccaggaatgtgtcaaacattttcctgggcgctgccggctttccgtccaccaggatactccatcccttatcatagggaatactggtatacataacgcctgctgcgtccgccgtaatgctgcctgacagttctgtatccgtccacctggaaagcaccaggggattctgattcattttcccgtaaacagcttccagggcctgtggattaaagcgccacacctctgcctgcagggttgggctgccctcatcccctgcctccagatgcacctgcgcatccttgttgatacggcccagttccatgaaatagccccggtccacattgtcaaagctttctgtctgctcgccgattacagccgtgacctccttcacctttttattggtcacatacacatagtaatcgcctgtttcctcggctgtaaatgtaagtttctttccctctgtaacgctttcgttgggcagaagcacatgctctgtatccagcacatcgcataaatcgttctggacatgggccggattccctgaatccaaaatccagtttccttccacatcccggggcagcatgaatgccacgggaagggtgaatttattctcgtacagccacatgcttccttttcttgcggacaactccctcagtccgtcggaaggctgctggtccccgtatatgccgtagcgcacggacaacaggctgtccaccaatggagtgcttcccgtgatgctgtaagcattggtagaactctcacaccccatcctgcggaagaaatccgacagggatgcattggcagtggatgagaacagggatacagatgggaaattcatccaggcaccgtcattctttgtctttctgtctgtcttttccacacggtaaaagctttccgcctttatattccacaccagttcttccacatcctggttatccttaacataggatgtcctgctggtggtgggaatactggtcactgcagtattcacagccgcctcaatggcaaccagggccagggccgtgagaagaatggcgtccagactccattttcccttgtggtactgataaaccagtccgccatacatggcaatgaataaaattgccacatagaatacggaaaaatggtactgttccggattattcaccagcttttcagccagcagcacaaaggtaacagctccccagaacgccaggcatatatgcttccatggcgtattctccagatggatgtaggcatggtaacacataaacagcatcagtgctatataaatgaaggactgccggcagggaaggctgttgggatagtgaaacccatgccagataaaattcagcacattaacggaaaagctggcgtaaaacagaatcagcatggtgcagtacactgctttttccctgaacgtaatcttcttactgcccagatagagcaggaagaacatgagcactgccacaccgcagtatatattaggccagtggtccagacctatttcggttcccacatttcctatgtggcgggcaatcatgtcaaaaatggaaaaataggaggaaaatgtcttgggaaagtcaaaatcccctgatgcagtgacctgcagcgcataaatctccggcagaagcaccaccgcggcaagaccgcctgccagcagggaataaaaggcaaaccgcagcccggttcccatgaattccccaaagcttttcggtggattgagtatcatctgcgcaatcacatagatgaccatgaaaatgcaaatcatgatggatatatagtaattggaaaggatggaaagacccagggtaatgcagtagagtgtccctcttttctcctttaccagctgttccagtcccaaaagaatcagcggaaacagcatgatgcagtccagccacatgatgttccagctataggcagccatatatccgctgagggcataaaaaataccgaaaaagcccacgccgaaattcttgactccaaagtgctttttcagataccatgaaaagctgagtccggacagtcctgttttaaggacaatcagtatggtcatgaactcaatgatgaactttttggggcatagtataaggagccagttcaccgggcttgccaggtaataggcataaagcgccgaaaaattcacccccatgccgatatcccagctgtaaagcaggcttccgccgtgggtcagcttatactggaactctgaaaaaaacggcgcatactgatgatacatatctgtcctgagaaaacattcttccccaaagggaaagatacctctctgggcaaatataataatcatggcaaccaccgggacaaaaaatgctgccaccagaccgtccgaaggctttaataaccgaagtccgcgcctgtttcctgtccgtgacatccctgtctttctctcatcgtactgctgcctgtcctgtccggcagtctcattctcttcttccattccgtattcgtcttcctctgatgtatattcgtctgatgcataatcatctgatgcgtaattatccgatgcgtatcctccgggactatactctccgtgattatgctctccgtgactatattctcctgaagcatatctcgctgaggcaaattccgccggcctgtcattcaccggaacacatccccgggaggcagccgcctcagatgcggcctctccgaatagatattcctccagcgtacattcttccggcaaacatccccccgcgccgcgggacctgaggtctcccctgtcctccctgcgggaatctgtcctgccggaatccgccccatatgttttcttatcctctgatgtctttttatccccgtcgggaaccggctcctctgagagcgcttcctccctggttttatcctgcatggtcggttctggctgcacaagcttcagaattgcgtcaagctcccgttcaacccgttctatctcttcacgttccatcacagtcacctttctctattcaggcttattcttgaatatccagagtttgctgaaaatatagttcagtaccatgttgatgacagaggatgtgaacttgcagaacagctcatacagcattcccctgtcaccgcctaattttaccatgacaaccataagcacccaggtaactgcccctgagaatgccctggcagctacaaatgctcccacctccttcacaaggtaggaaggtcttagattgtaattgcggaacacaatcagcttgttcaccacataggcaaacagcacagccgccagccatgacatggcctgggacaggcccacgccaatctcaatctgcctcagcagggcatatacggcaaagtccactgccgtggtaaggaacccgcatataatgtagcttaccgtctcatagttaacacatttttcccatattttacgtaacatcttctgctcctgctttgttccagagtgtacgcagaccggccctggagcaataatcccttctattatatggtagcatcatggaattgtaaagaacaaaccattatctgtacaggaaatcctccgcccccctggtataatggagttccccgtcatccgtgagaaatatgccgtagatgcggtccatggactctatgagcctggttccctcctccagccccagggcaaagcaggtggtgctcagcccgtccccgtccactgacctgggtgaaatgatggatacctgggtcagaccgttttcatagggatatccggtggccgggtccagtatgtgatgatagttgacgccatcctccacaaaatgacgctcgtatacaccggaggaaaccacagacataccgtctatcttcagcgctgccactgtctccgtatgggttgcatagggtctttgaagccctatcttaaagggactgccgtccgggcgttttcccacgcagagcacattaccgcccaggttaatgaccgcgcttttcactccctgttcctccaggtacgccttcatctggtctgctatgaaacccttggctatggctcccaggtcaatggtggtatcgtcgttgaggaaggtgacctggttcccatccagaatcacattcttatatcccactttttttaaatccgcctcaatttcctccctgggaggtacatggggcgtttcaccggtaaaatcccaaagggaacttaagggctctatggtaatgtcaaaggccccccgggacacacggcagtactccagcccctccgccagaacctgggctgttttctccgatacggtaatggttctctcccccggtctgcggtggttcattttataaatctcactgccctccagagtcttgctgagcagtttctcatagtcggagcacagagccatgcagccgtccagtatggtctggtcttctgaatcatataaggttacagttacaaatgtgttcaacaaaaaagacgacctggtgacaggatccgcaactttcttgctgcatcctgccagccaagccgtgcacacgataatcaaacctgctgttattattgtctttaatcctgtatttttcatgccttacattctagcacccgtccctgtaaaagtcaaggcaggaggctttaggcattggtttcttccatatactcatccattacagcgtccagaatcttcttaatagtctcaggcgccctgcctcccaccggagtaccgtcaatctcattggcagccacacacagtttggtggatgatgtcaccagaacctcgtccgcatccatcatctccttcagggtatagggagtctcacttaccggaatctccagtttcttgcaaatgcgaatcagatgggcccttgcaatacccggaagtatcaggttgtcggcaggggctgtgtagagaatgccgtcctttaggatatggcagttgctgtgggcgcattctgttacacggtcgcctctgtggaatactgcttcctggcatcctgcctcttttgccttctgggcagccataacgctgggcagcaggttcagggttttgatgttgcagtggaagaaacgggtatcctcctgggtgagcaggcgaatcttcttatacaggtccggtgttcccatgggctttagcataacccagagattggccggtacgttatccgggaattcatgggtcctgacagcagtgccgcgggttacctggaagtaaatgaacaaatcccctgtatccatcttattgaccaggtcctgaagcagggccttcagctctgcctttgtacagggcacctgaatcttgataaggcccgcgctgttgaagaagcggtcaatgtgctcgtcgattgcgaaaatcttgtaattgcggcagggacctgcatcgtatacgccgtccccaaaccagcacaccctgtcattcatgggaacactcatgttctccagttcgtcgtactttccattataatagccaagcgttttcatatatgtaatctcctttttaataataattctcattgaaacatgaagctaaaaccgctttttctcttcttccggtatggcggaatacatgtttttgatttccttcagcacgaaatgggtcctggtggctgatacaccgggtatgctcttgatggtgcggtggatacgctccagctcatcggaggaggcgcatgatatcttcagcacaaagtcataatccccggtcagatagtaacagtccaggatattgggatggtccatgatgacctcggtaaaggaatcgtggaacctgggatgctccaggctgatttccatcagggccgtgacatcgttgcccagggccttggcatccactcttaccgtatagcccttgatgatgccggactcttccatcttcttgatgcggtccaggacggctgatacggacaggtgaatggccttgctgatgtctgaggctgtctcccttccgttctcttttaggatattcagtattttatagtcaagtttatccatcttgtccccctgttattttagcttttcaaatatagtttcgtagtatatactggtaggtggatagaatgcattgtccccgaatcatcggcggcacaggctttgctttccggcaggagccttctcaatgcctgcgtggacattataacacaaatcatccaggagttgtactatgaatctctcttatttgaaatatgcggtagaagtggaaaaaactgggtccatcacaaaggcggctcagaatttttatatgaatcagccccatctgagtaaaatcatccgtgaactggaacgggacctgggatgcgatatcttcgacagaaccagccgcggcatggttcccaccaaaaagggcgaggaattcctgcgctatgcaagggcaatcctggtgcaggaggaacagatagaggctctctgcgtaaagaacggcgaaaaggccctggaggtgaatctctgtgttcccagagccacctatatttcctacgccttctctgaattccttaagcatatggacacctgtccctccgtcaatgtgcattacatggaaaccaactccagggatactatccggggcgtgtccggcaagacctttgatgtgggcatcatacgctgtcagtccctgtatgaatcctattatatgaagcttctccaggatgagaacctggagtggaaggagctgtggcagttttcctgtaatgttcttatgtcccccagccaccccctggcttccaggaacgggctgacttatctggattttacggattacattgaaatcgtccagggggacatccagaacccgtcctttacctttgaggcccaggacgcctctgccaccggcggcaactccaagaaaaccgtttccatctatgacaggggcagccagtttgagctgctgcgccagctgcccggttcctacatgtggacctccccggtcccctgcggctgcctcaccacctcgggcctgattcaaaaaacctgcagttatcccggcaacctccacaaggacctgctgatttacaggaacggctaccgtttttccaaggaagaggaggaattcctccggtgcctctcacgtatgataagccggctctctgactgattatcagtgatttgcctcattccttccatatatatattctataagcccgtcagcctctcacattgcagcggctgacgggcttatagtatgtgataaccggtgtaatccggcttattatctaaggaaatactctgtttccggaaaacgccctttatttcctattatataaggcagtctcccatattaccatgacccggaaagaatcctggccagctcactgtcctcgttcagtataacggtcttattatcccctttcagggaagccttcagggcatccagggagcgcacataattatagaagtcagcctttgcctcgtcattgtaggcatcgcttaatatctgcatgtacctggcctcgccctctgccttgattttttccgcctccgcattggcctttgcaatggtttcctttactgtcttgtctgtctcgttcttaatcagggaggactgataatcgccgtcagccgtgtactgggcagcaatgttgtttcgctcggatatcattctctggtatacagactccttattggagtcgggaaggtccagcttctttgtctccaccgcataaatgtggatgccgtaggaatccatggcgttgccaatgttctccgtaatggtcctggccaggttcccgtcccggccggatatgatatccgcctggttggtggatgagagcacattcttaatagagttatataccacatttcccagcctgacctcagctttttccttgctggcgttcagggaggccagatatttcaccgggtcgttgatatcccatataacaaaggaatcaacggtcatcacctttttatcctttgtggtgacatcgcttgggtacaggtcggatatcattttatatttgggtattttctgcacagactgcaggaaggggaccctgagggagggacctgccgaatcctccaccctgactacttttccgaactggataatcagggagtactcattggatttggtaaccaccagcggattaaagatggtgacagccaggagcacgataaccagtattcccatgtttctcataaatttcgtcaatgtcttcattactgtccgcctccgttctggtcattgttttcatccgtatcatcctggtcataggcgccggactggctgctttggctgcctgaaccctcctggctggcctggtttgcctggtttgtctgattatcctggctgctgtaggaaccctgtgaaccggtgccggtctggggtccggtgacaaaggaatccagaggaagcatggtctgggtcccgtctgagccgtttatgataacctttaaacccggcaggatatcctccatggtttcatagaacattctcttctttgtgataagcggatactttgcatattcctggtacatatcgttgaacctggatacctggccctctgcctcgctgattctctgctggcggtaggcttccgcatccctggcagctttatcggcctttgcgttggctgccggaagctgctgggactggtacttcctggcctcattgattttggtatccataccctgcttggcatcctccactgccttaaatgcattgttcactgcatccgttggaggctgcgcgtcctggatggtcacattgttgatgcccaggccgatgtcctcctgctccaggcgctcagacagcagcgccttgacctttgcctgaatctcggattttccggtggttattacctcgtccacgctgtaggagccgacggtatcccttatataggactgggccaggttctttaaaataggaatggccgtgtcgctgtggatgtatgctttaattgggtccacaatctgatattcaatataaaaatccacattcacaaagttaaaatccttggttatcatctctgactcggacgtaaccgaaacaggattgttctcgctgtccgcatgattctgcgcattgtagtccgggtcgtatccaatgggcataccctttatttccttggacatcttatgtaccttctgtatgaagggcaccttgaacttgggtcctgaggtagttacgctgctgggacgtccgaaggtggtcagcactgccatctcattttcagacagggtgtagaacgaatcaaaggccgctattgccaggacagccaccacaatggctatctttatgggacggagcatcttcttcatcctcttattgctttcttccccgttgtcaaatactacttccggtccctgtttattgctgcctcctccaggtcccacgaacttcttacccatgaaaaaattcatccggtattcccctttctcagtcattttagagaagtataccataagtttcacataccggatagcatttaccctgagtttccaataattttataattcctttagggagatgccggaaaaggaataccggtattcctttttcatacctacccattcccggtcaatggtgttaagatataatcgttaaagaaataacacactgacacaatattttacatataatgggaggtattatcatgagatttacactgccaagagatttgtaccatggaaaagatgcactggatgccctgaagaccctgaccggcagaaaagccattgtggttgtgggcggcggctccatgaaacgttttggttttctggacaaggtggttgattacctgaaggaagccggcatggaagttaaattattcgaaggcgttgagcctgacccatctgtagatacagtcatgaagggcgctgctgccatgcaggaatttgagcctgactggattgtggcagtaggcggcggttctcccattgatgcagcaaaggcaatgtgggcattttacgaatacccggagacatcctttgaggacctgattacgccattcaacttcccaaccctgcgtaccaaagctaaattctgtgcgatttcctccacatcaggaacagcaaccgaggttaccgcattttccgttattactgattataagaaaggcatcaaatatcctctggccgacttcaacatcacaccggatgtggctattgtggaccctgccctggctgaaaccatgcccaagaagctgacagcccatacaggaatggatgccatgacccacgcaattgaggcttatgtctcaacccttcactgcgagtatacggacccgttagctctccatgccatcgagatgattaacgagtatctgataccttcttataacggggacatggaagcccgtgataagatgcacgatgcacagtgtctggccggaatggcgttctccaatgctttgcttggaatcgtacactccatggcccataagacaggtgctgcatattccggcggtcacattgttcacggttgtgctaatgcaatgtacctccccaaggttattaaatataactccaaagaacctgaggccgccgccagatatgctaagattgccaaattcatcagccttcccggcaccacggacgaggaactgaccgatgcccttattgcccgtctcttagagatgaacaaggctctggacatccccgcctgtataaaggattacgagggcggaatcattgatgagaaggaattcatggataagcttccacaggttgccgaactggctgtaggcgatgcctgcaccgggtccaatccaagggccatcacccccaaggttatggaacagctgctgaaatgctgctactatgacgaggaagtgaacttttaaaaagcccccttttgtgttaatacactccatataaacggtttgtttttactgcccgaaaagggtgggaaagaattcgtctttcccacccttttcattttgccgcctttacgctgccagaagctgttccatatagcgcagatatccgcacagtcctgtgatgatgaatatttccagaaagctggtgataaagcctgcttccaggaggaagaggacggagcaggctgccatcatccacaaaattccccacgccctgcgaaagcgcatccggtcacgggcgctgagaaagcggaggaaaccaatgatgctgaaggccagaagcacaggcgaaaaaaatgccagcagcacatggaggtctgcctttaagggatattcctccggcatgtagggaatcataactgccataagaagaaaggctgccgcggtatacatgagcgtccttcctcccggattcctgtatcttcctatgtgaaaaagataacggacatacacacagtaatagatgccggtggcaaatccccacactgcaaacagcagcttattgccggtccggttgcccaggacagacaggttggtaccggtccagctgtcaaaggatgccaggaatatggttacgccgggaatcagataaatcgtgaagaggtcgtattttcctttaaaccgtatgttccggccccacatggtcctgccccctttatcagatggtccctgcccttaaatctgtcccggacctccttatacatggatatccgggacaatgaggaagggagcgcacgcatctttttccgatgcgccgctccctatcattatctgataaagtggtgatttttacacttgaatcattttccttggaaggtatctgccctccaattatgccattgtttttaaaagcttttccactgaggaaagcttcacgcaaagggtgaacagttcggcagccataatcaaatcccctaatgtgggataggtgggggcgatacggatgttgcagtcatgcgggtcctttccatatggataggtggctccggccgatgtcatgaccacgcctgccttcttgcacctggccacgatatcctttgcgcagccttccatggaatcaaaggagataaagtatccgccctttggttttgtccactgtccgattcccagcccttccagctcccgtcccaatatttcctccactgcctcgaatttggggcggataatgtctgcatgttttctcatatgctctaccataccatggatatccttaaagaaacgggcatggcgcagctgatttaccttgtcgtggccaatggtctggttctttaactgggccttgatgtcctccaggttattgtgggaggtggcaatggccgcaataccggaaccagggaagctgattttggaggtggaagcaaatttataaaccaggtccggatttccagccctcttacactctgccagaatctcaatcagatggtcctggtcgtggtcatacaggtgatgtacgccgtaagcattatcccagaatatacggaagtccgaggcagccggtttcagccttgcaaaacggcggaccgtctcgtctgaataggaatagccctggggattggagtacttgggcacgcaccagattcccttgatggaatcatcggaagccaccagttcctccaccatatccatatctggtccatcctcagacatgggcacgttaatcatctcaatgccgaagtattcggtgatagcgaaatggcggtcatatccgggaaccgggcagagaaatttcaccttatccagcttgcaccagggtgtgcatcccatgattccgtgggtcatggccctggacacggtatcgtacataacgttcaggctggagttgccgtaaatgataatggtggaagggttcacctccatcatatctgccagcagtaccttggcctcgtctatacctgtcagcacgccgtaattgcggcagtccgttccgtcctcgcaggtcaggtcactggcgctgttcagtacgtccatcatacccatggaaaggtccagctgttccacacatggcttacccctggacatatccagcttcaggtcctttgcctgaaactcccggtactgtgctttcaggtcctggcgcagtgaaagcagttcttcttttgtcatctctgcatatggcttcataatatcctcctggctcactatattttctataaaatgtgtccgtcaggcagacatctgtcagccaccggtcaacatttttgtacattgtactaaagcatacaccaattgaagcattccgtcaatacaaaattttcttatattgtcaaaagatatgcttatgtctttttccttctgcctctatccctgcttatacgtctctgcttgttcatccctgcctaaacatccctgcctaaacgtccttaccggcaagcagctccttcacaagcttatttaccatggccgggtccgcctttcccttcatggccttcatagtccggcccaccagaaatcccatggccttttccttgccgttcctgtaatcctccacggactgcggattcgctgccattaccgcctccgcggtgctgcgcagggttccttcgtccgttaccaccttaaggcccttttcctccacatacttcccagggtcaatatcgtgcctgaatatctcctcaaacacagtcctggcaactgttctgttaatggtgtttttctccaccataccgataagggcagccagatgggcgggcgaaaatctcatgtcctccgggtccatttcctgctccttcatcagacgcatggcctccaccataagccagttggatacctccttgggctgtccgctcagccgcgtggtctcctcaaagatatccgccatgtgcttagagctggtgagcagcctggcgtcatattcaggaagtccgtattcctctctgtagcggatgattttctctgtgcgcagctccggctggcgggcctttacccgggcaatccattcatcgcttatgaccaccggcgccaggtctgggtcaggaaaatacctgtaatcctgggcatcctccttggagcgcatggccttggaactttccttgttgtcatcccagcgccgcgtctcctggattaccttctttccctcttccagcagctcaatctggcgcctgcgctccccctcgatggccctggcgatggccttaaaggagttcaggtttttcatctctgtcctggtgccaaacgaaggcgcacctgcctcccttacggacaggttcacatccaccctcatggagccttcctggagcttgcagtcagaggcccccaggtactggataatcagcctcagcttctccagatacgctatgacttcctcggcgctgcgcatatccggctccgatacaatctcaatcagaggaacaccgctgcggttgtaatccaccagggaacagtcctcccactcatcgtgaatcagcttgcctgcatcctcctccatatggatttcgtggattcccacacgtttcctgctgccggattctgtctctatgtccacccagccgtcatggcagataggcaggtagagctgggatatctggtagttctgcgggttgtccggataaaaataattcttccggtcaaatttacagtactggttaatccggcagttgacagccagccccactgccagcgcatactccaccacctgcttattcagcacgggcagggaaccgggcataccggtgcacacaggacaggtatgggtgttgggctctcccccgaaacgggtggaacagccgcagaaaatcttggttttggtggccagctccacatggacttccagacctatgacagtctcgtactgtttactcatggctcatcctcctctctgctgtcccggtcatggcgccggacagtacctctgctgtcccggccgtcacagaaggcagcttccacttccgggactgctcgtaagcataggcggcccgtatgatgttcttttccttaaaacagtcccctatgagctgcaggccaatgggaagcccttttgaatccaggccgcagggaaggctgattcccggaaggccggccaggttcacggaaatggtatagatatcccccagatacatcttcagcgggtcccccagggactggcccagccgcggagcagtccctggcgctgcaggcgccagtattacgtcgtacgatgcaaaggcccggtcaaattccttcttaatcagcgccttggtgcggagggccttcagataatatgcgtcatagtagccggaactcagcacaaaggagcccaacatgatgcggcgcttcacctccgggccaaatccctgggaacggcttttcttgtacatgctgtgaaggtcctcgtactccggcgcacggtacccgtactttaccccgtcaaaccgcgacaggttggaactggcttctgcggaggcaatgacatagtaagcaggtatggcatattccaccagcttaaggtcaaaggtttccaccacagcccccatttcccccagtaccccggctgcttccagcacagcgtcccttacctcctggtccagaccctggccaaagtaggattccggtatgccgatgcgcattccctttacatccgatgacagggccgaagtaaaaccgcagtccccgcgctccatggacgtgctgtcctttgggtcgtgggaggccaggacctccagaattgcagcgcagtccgacacgtcctttgccacaggcccaatctggtccagagaagaaccataggcaatgagcccatacctggacacggtaccgtaggtgggcttgattcccgtgacaccgcagaaggcgctgggctggcgtatggaaccgcctgtatcggaccccagggcataaaagcattccccggcagccaccgctgcacaggaaccgccggaggagccccccggcacatgctccgtgttccagggattcctggtaaccccgaaggcagatgtctccgtggtgcttcccatggcaaattcatccatgttggtctttcccaggatgacggctcctgcctgttccagattggccacggcctgggccgtataggttggaacaaaatgttccagtatcctggagctgcaggtggtgcgcattccttccgtgcacatgttatccttgatggccacaggcacacccgccagggggccggtcagccttcctgcctcaatttccgcctggacctttccggcccgttccatggtcctctcttcgtccacagtcacgtaggcgtgaatggatggctccacggctttcatccgtgccagggatgcttctgcggcctgaaccgcggtgatttcccctgactgaatccttcttcccagctccagggctgtcatatccaatatgctcatgctcccattcctcctactctacggtcttgggcactttaaatgctccgtccttgtgccggggtgcgttggacaggatgcgctccctctcatccccatttgttactatatcctcacggaacacgttatttaacggaaatacgtgggacatgggctccactccctgtgtgtccagttcattgagcttatctatataatccagcatccttcccatatccttctttgcttcctccttttcctccggagaaagttccagcttagccaggatgcccgcgtattctattgtctggtcgcttattttgtttgccatgattttctgctcctctcagtcatattcctgttcctatggctccagcctgttcacatcccttgggaacaatgcggcttccctgacattctgctcatccagaagcctcatggtaaggcgttccaggccaatgcccagtccgccgtggggcggcataccgtatttgaaaatcatcagataggaagcaatatcctctggattcatgccccgcttctccatcttggctgttatttccttgtaatcgtgaatcctctgtccgcccgtggtcacctccagtccgcggaacaaaaggtcaaaactcagtgtgaatttggggtctgccgggtcatccattgcgtagaacggccgctttttagacggataatgggtaacaaacacaaaatcgctgccgtactcttcccggaaataccgccctatgagcagttcctcctccggctccaaatcatagggattgcgtatcctcctgtcatacctgcgggacacaagctccttggcctggtcaaagcggacagcgggaatccgtcccacctccggcagggtcactcccagcatatccagctcctgtttatactcctgctccagcagcctcataacatgctggagcattcctgtctccatatccatcacatcccggaaactgtcaatatatcccatctcaaaatccaggcttgtatattcgttgagatggcgggtggtattatgcttttcagcgcggaacaccggggctgcctcaaataccctgtcgtacactcccaccatggtctgcttatagaactggggactctgtcccagctccgccttcttattaaaatactccagcttaaaaacattggagccgccctctgcccctcttgccacgattttgggggtacgtatctccgtaaagccctgtccggcaagataatccctgaatcctcttacaataccctcctgaatcttgaatttggcccgttcccgcacattgcgcagggaaatgggacgcagggagagctttgtctccagggacgtgtttaacttccatttgctgacagccaggggaaggggctctgccggctgggacagcacctgtatttccttcagccgtatctcaaatccatggggtgcccgttcctcggcccttagagtccccctcacctccacggcgctctcttccttcaattccctgatatcaaaatccgtaacccctgcctcgtacacgcactgcaccagtccctgggacttgcgcagaatgacgaaagccacctcccccatatggcgtatggtgtgaaccgctccgttcatccgtatatccctgccctcataatcccctgcaagcacttccctgatatccaggaccttcttctccttaactccgctgataaattccatggcactctctcctcgctatgagcacttgacatctgtgttttaagatgtctagtgcgatgcatatcactggcacttggcaggcgtattttgactgcctagtgcagtgattcgctatgagcacttgacatctgtgtttcggttccggttcattctcttctccatggacacaagccggctgtctggcccacaaacaaaaaaacgccccggaacacagtaactgcattccgggacgggatttacttcagacatttcccgcggtaccacccgcattgagacctggtcccgtatcacactgccatacgtttccagctctcctctctatgtacgtaacgtgtacaacggatatacctactatcagccgcgtcctgcccggcagcctccggttcagtccctgaccgcttcgatataccagctccagagtgttcccttagcccagtcctgcctggcggcgctctcagtcggtgacgcccccttcctgtcacatttctcaggccagagtctctttcattgctgttgattatttatttactaaaatagtacatcgcggattcaaagtcaagggcaaatatttctccgggaagaattttagataatttaaccataaattcatacatgtctgaatatttattgtaacaattgaaagtgtcagccgccgtcctatggcagggccggaaaacaggacatgataggtcaatgggtgtcatagttttgctctctccctcataaaatgctatatggaaattactatacacataaaggagctcatgatgttatccatccatgattttcattattcctccgatgtaccctatccgcccatcaaggctgaatccggaaatccggcctatgcaagggtgatgttggacaacataggcggaagcaattcagagatgtccgccatatctctctatatcttcaaccagctgattaccgggtacaatcccgatatcagcgccgtatttcacaaggtcagtattgtggaaatgcatcacctggaaatattcggaacattggcgcagcagctgggggaggaaccgcggctgtggacacagcacggatgcaagaagatatactggtcccccagctacaaccagtatcccgaagacctgggggcactgatgcgcaatgtcattgacggtgaaaaggcagccatcagcaaatatcagcaccagatttcctacatacgggatgaaaatatcacagagaatttacggcgcattattttggatgaacggctgcacgtggagatttttgaaaaggtctacggagcgtattgttcctgaacagccttacgcatggcgtatattcgtatactccgatatctccctgctgatggtgcacaaatcgtccacatccatgtggtgaatgtcgtcatgccctgtaatcctggcaaatgtcttaatctcttccagggataccctgaggaaattagccactctctgcgcagctgcgtcctcccttaagcggctgcgcagctttgcgtcctgggttgccactcctacggggcacatacctgtgccgcatatgcggtactgctggcaggctgctgccatcaatgcagcggatgcaaccgcaaccgcgtccgctcccatggccagcgcctttgcaaaatcagaggatacccgcagaccgcctgttaccaccagctgggcgtcgcaccccgcctggtccagatatttcctggccctgtaaagggcataaaccgtgggcacgctggtggagtccctgataatcctgggactggcaccggttgcgcctccccttccgtctatggtaatgaaatccggtcccccatagacgcagaattccaaatccttctcaatccttcccgctgctatcttaatgccaatgggccgtcccccggacacaaaacgcagtctgtccaccagggctttcaaatcctctttggtatcaatgcctggaaaacgcgacgggctgataacatcctggcccagaggtttattccttatggcggcaatctccggcgtcaccttgcctcccggaagatggccgcccataccgggctttgtgccctgtccgatttttatctctatggcgtccgcatccctcaggttctggtcagtgacactatactggttgggcacgtattcaaatatatacttataggctgctgctttttcctccggcagtatgcctccctcgccggagcacatggcggtgcggaccatggcgcttcccctggacagcgctgtctttgcctccctggaaagagctccaaaggacatgtgggaaatataaacaggatggtccaggaccatgggcttggccgcatgttttcctataatggtttcggtctttaccggggcatgttcatccaatggcatgggattcagctgggcgcccagaaacaggatatcgtcccagcccggcatgggcatctgtgttcccatggcagcaatgatggactgtcccttcaccgccatctcgtgaatctcgtccatatagcgggcatcggtctgggtcctggcatactccgggtcataggcctctgcctcgcccgtaccggcgccgcagccttcacatttttcctgagcctcttcctttttggccggcgcctccatccccttcccattctccgggttcctgtctccgtcctcagtcttcaccagcttgtcagccgtgaccatgcacacgggacagacctttaaatcagataccggcaccccctccttttcctcgtcataaatagaaccacaaaatctgcaacggtatactgccattctgtttcccccttctcttggtttacctttaataatagtaattattactattttaaatatagcacaaacacactgcaatgtccagtgttttataccttcatatatcattgacttacctgtataaataatgttacaatatctttcatgcacaaacgagaaaggaagtcgctatacaatgtcccaagaaaacaagatgggtgtcatgcccattaataaactgctgatatccatgtccctgcccatgattatctctatgctggtacaggccctgtacaatatcgtggacagcgtgtttgtatccatgattaaccaggctgccctgaccgcagtatccatggcatttcccatccagaacctgctgattgcggtgtctgccggtacctgtgtgggtgtcaacgccctgctgtcccgttccctgggggagaaaaatcccaaggctgccaacctggctgctgtcaacgggctgttcctggccttcttaagcttcctggcctttgcagtcttcggcctgttcggcgccaggctgttctttgaaagccagacaaccaatccggtcatcattgaatacggcgtacagtatcttcagattgtctgcctcttcagtttcgggctctttggggaaatgatgtttgaaaggattctccagtccacaggccagaccttttactgtatgattacacagggcaccggcgccatcatcaatatcatactggaccccattcttatcttcggcctgttcggagtgcctgcgatgggaattcagggtgctgcagcagccactgtattcggccagattgtggccatgttcctggcccttgcactgaaccataccaaaaacaaggatgtgcgcatcagtttcaggggatttacccctaaccggaagactatttctgttatctaccaggtgggcgtgccctccatcatcatgcagtccatcagctctgtcatgacctttggaatgaacaagattctgattggattttctgagacagccgtcgctgtattcggagtgtatttcaagcttcagagctttatcttcatgccgatattcggactgaacaacggtatgatacccattgtagcctataactacggggcgcgcagcaaaaagcgcatcatggagacggtccgcctgagcatcggcattgcagtcggcatcatgctcgccggactgttggtgttccatctcatgacgccccagctgctgctgctcttccaggcagacgaggaaatgctgtccatcggcgtccccgcactccgcatcatcagcctcagcttcctgtttgcaggttactgcatcatcgtaggctctgtattccaggccctgggcaacggcgtatacagcctgattatatccgtggccagacagctggtatgtatcctccccctggcctggttctttgcccaatcctttgggctgcacgcagtgtggttctccctgcctctggctgaaatcacctccgtggtgctcagttccgtcctgttccgcaagatttatctggataagataaagcccctgggacagcctgccgcctgacggcggccggatgagccatatgattgcggatgctgatttaagtccgcatgctgatttaaatccatataactcacagacaaaaagcgggctgtccgggaatgtaaactgttcccggacggcccgtctctctgctgtgctgctgtgtttcttaatcttgtacttccattttattccctactctgccgcataattcagtcttaccgtaatattggcagtcttgtacctggagctggtatccaggtacccgtcgtagctgtaggattccgacccggaattcttggccgtaatctggaacacgcccaaggtggcgcttaacagcttgcctgcctttgctcctgagccggcggacatgatgtcgatgcgctcctttgcattagcagtggccttttcaatcaggtccagctttacctcatccagcttggtgtaataatattccggcagattggactcaaactccactcctgattcaatcagcttggtgatgtccctggagatattctccaccttgtcaatatcgtaggatgataccgtcaggctctgagtcaggtcatatccctccggctcatctcccaggtacctgccctcatcgtcgtatcgggacgtataggtctgggaaatattcacggagctgaatatcatctcatcctccgccacctggttttcctccagataccgccttaccagttccgcatcctttttgataatggcataggcatcctttggcgtgttcccatgaaccgaaaagctgcctctccacactatcaggtccgattcaaaatcacagctggctgaaccggttgcagtgattccgcttcctccgccgctcttcttataattcaccagtccgccggtaaagatgctgacgcagataatggctccaattgtggcaataagcgcgataagcacggacctgccctgggccgggaaacctgccctttcctttttctccttgttctcttccaatccctcacaaacctcctttgacatgttcttacaaacctgcgcgccctgcgcaggatgtgatggtcttagtatagcacgtaagagttgaaagagacctaacggctttcttaatatttacggtcaaaataggggcttcatcatacctatatcaaggcatccagccgtttaagggcttcaatgtatatcaccatggcattggtaaggttctcaatcctcacacactcatcgggctggtggcctccgccgtgtccgggagggcagggctttttctgtcccctgatacccggtccaaaggcaactgcattaggcagcttcctggcataggtgcctccgcccatggagtaggctttgtcctctgtccccagcacctggctgcacagggcggtcagctcctttaccaccgggctttccgggtcaatgacacagggcgggttatcccggctccagtccagtatccagccgtattgcctggctgctgcgctcatctgctccaccagggatgccgcatccgctgttaccggatagcggatattgaaattctggatgaaccttcccctttctgtccgggccatgcctcccaccagggtaagcctgccggacagggaatcctcaaaccggaggttcattccttccccataataatccgcaaatccctggtccagaaaccggaagcaggtcctttcctcttctgtcagaaagggagctcctgccagcatatgggccagcttcacggccgcactgtcagacccctcaggaaaggcagcgtgggcagtctttcctgaggcctttaccaggatgccgccattgtccgacactgtaaaatcctgccggttctccaggctgtccacataggccctgaccgtctcacaggcaacctggtccaggtatacccgggcctctgccggaactgcattggatgccaccccggcggaaaacatggccccatggccctccggaatcccgcatgaaaattccccttccagaattcccttttccccgtagcagacaggaaaggaagcgtccggcgtaaaagagaactccggagtaggataatgggaggtgtagtactcaatatcctccatcccccgttcctcactgcatcccagatacagccgtatggtgtgctccagccgtattccctgctccttcagatatttcatgctgtagagcgcggcagcggcaggccccttgttgtccgcacttccccggccgtacagccacccgtccttcaccacgggtacgtaggggtctgtactccatccgtttccctcatgcaccacatccagatggacgaacatgccgatttccttccccgtcctgcccggcataaggatgcttccgcagtggtagccatggttttccgtctcaaatcccatgctccgtccaatctccagggccctgtccaataccaaggcgcagccctccccgtagggatgttcccctgttcccggttcgctgacactgcggattttcattagctccatggcagtatccagcatattgtctctctggtccaatacccattcttttacatccatattcttacttccctctatttgtggccgttcggacggcgcgtttattcgtcatacagatgacaggccacaaaatgcctgtcccccacatcctttaattccggcacctgggtgcggcatttttccgtggcataacggcatctggtgtggaaccggcatccctggggcggattaaaggggctgggtacatccccctccaggtggattttattgtactggatatccatatcaggaatggggatggctgaaagaagggcctgggtgtagggatgccttgcatcctcatacagcgccttcttgtccgcaatttccattacatttcccagatacatgaccatgatgcggtcacagatataccgcaccacgctcaggtcatgggaaatgaacagataggtcaaatccagctccttctgaaggtccatcatcaggttcagcacctgggcccggaccgacacatccagggccgataccggctcgtcgcacaccacaaatctgggattcagcaccaacgccctggcaatgacgattctctggcgctgtccgcctgaaaactcatggggatagcggttcatgaattccagcggaagtcccaccttatccatgatttggattaccctggcctccttttcctcctttgttcccatggcaaatacatccaatggggcacaaatcagttccctgaccgtcatacgcggattcagggaggaataggggtcctggaaaatgatttggagttccctgcgcatctggcgcatctcttccttgccgtatcctgccagattgtttccccggtaaaccacctgcccctccgttggttcgtgaagacgcagaatggtcctgcccagggtggacttgccgcagcccgactctcccaccactcccagtgtctccccgtactccatggaaaagctgacgccgtccagggcctttaccgcccttggctcctttccccttcgtctcttgccggagaaaaagtatttctttaaatctttgacttccaggattgtctcattgctgctcatgccttttcctccttaagattctcatacttccagcagctcaccttgtgtccgtcatccgtgatatacaccggcggctggtgctccctgcatttgtccatggaatagagacagcgggcgcagaacctgcacccctttggcatcctgtccagggacggcaccgtaccgtcaatggagaacaggcggtccgaatccttgtcaaggcggggtatggaagctaaaaggccctgtgtataaggatgcatggcctccttgaatatctgtctggcactgccgtactccataaccttgccggcgtacatgaccatgatgtagtcggccatctcagccaccacgcccatgtcatgggtgataagaatgatggaagcattgattttcttcttaagctccaccatcaggtcgataatctgggcctggatggtaacgtccagcgcagtggtgggctcgtctgcaatcagaagggagggattgcatgacagcgccatggcaatcatgaccctctgcctcattccccctgacagctgatgggggaattccttcagcctctgctccggagaagagacaccaacctttgtaaggatatccagggcctgccttttaatctcatccttagaaaggctgctgtgtacggagatggtttcctccagctgtcttccaatggtgagcacaggattcagggatgtcatggagtcctggaatatcatggatatctccctgcctcttatccggcacatctccttattcccttttttggcaatatcctcgcccttataaaggatttcaccgcctgccacagaacccactgcatggggcagcagctgcaggatggacagggaagtgacgctcttgccgcagccggattccccgacaatgcccagggtgtctccctcgtttacggaaaagctcacatcgtccacggcagtcacagtcccccttttggtcctgaactgtgtctttaaatgtttaacctctaataatggctgtgccatattctacctcctttgcagggccggcaccgggaatatcccggtgcctgtgctgcgtaatgactattctacatgccattcccagacggaacggttcaaaaggctgtaatcctcaaagcatacattggagattttcttgttgtaggcaaccaggtctttctggaaataaagccatacaaaggggcactgctccctgagcatcatctggtattcatcgtagaatggctttctctcctcaaagctgaactggttcaggccctttcttcccacctcgcccagggacgggtcctcattctgggaaaagttgttcagatggccaggtgtcacgttcatcacgctctcgcccgggtccggtgaaccgccggagccaatcagcgcaaagtcatactcgcctttccttgctgtggacagcagggttgggtggtctgtggtgatgatttccacgttaatgccaatcttggcaaggtcctgctgaatcatgggagctgatttttcacgcacctcgttgccctttgacacgttgagacggtaggtcttgctggtatcaaatccggcgtcctccaccatctgttttgccttgtccacgtcataagggatgggaagaagcgcttcattgaaatatctgtggcttggagccaggggaccgggagccggtacgccttcgcccttcatcaggttattgaccagggcgtcgcggttaatggccatgttcactgcctggcgtacttcctggggaatattcttggtgttgcaggaaagatactggtaacccagggattccactgcctctgtggtcaggttctcctgctgctgcgccatatcccagtcattcagcggaatatttccgataccagcgcctgccacaatatcaatctccccgttcatcaggccggacagcagattggatgcaggtacaattttaaccacaaaacggtcaaattcaggggcatttatgtagtaatccttattggctgtgaattccacgcgctcgccggatatctcggactcatagatacatgggccggaaccaatgggagccttccagaaatcagctgccagcatgtcccctgcaggaatatcctccaggcagtgcttcggcaggatgtaaaaatcgcggaacataatgtccagcatataatccaggttggtggggtccttaagcgtaaattccacggtgttggcgtcaatggccttcacgccgaactcctctccctccacgcggattccgtcctctgtacctgcaaagggagctaccttggaacggcgggccacgctgatgtcagggtcggacatgagcattgctgtgtataccacatcgtctgctgtcacaggctggccgtcatgccacttggcgttcttgttcaggttaaatgtaatcttggtatgagtctcatcatccatggaccaggagtccgccagacgcggcttaaaagagccgtctgcctttaccactatcagcttgtcaaaaatcagttccagcacagcgtccgtgttggcgttggtggtattaaagggaatcagggtatcccatggcgccgtcatggccatggtcacaattttctgctcctggccggccgtattctcctgggcatttccctctgcctttgcatccccgccctctgcggctgttcctgctgcggttgctgcaggcgccttggtatcgctgggcgctgaaggtgctgaacagccggacagcgccatcataaggcacagggcaagagctgtcatttttgttgaacgttttctcattactatatcctcctttttaattcaagcctttgcggcgttgattttcaacttattactccaaatttatttgatgaccatcttggtatccagggcatccctggccccgtctcccaggaaattgatgcagagcacggtaatcagcagggccaggccaggcggaaaccagagccacggtctctgggaaagcacgctgatggactgggcatcatagaggatgtttccccaggatgcctgcggcgcctggactcccattcccagaaagctcagggctgattccgtaataatggcctgggctgcacggaatgtaaaggaaataagcaccggtgcaaatgtattgggcagtatgtattttgtcagaatggtgccgtcctttgtgccgatggccctggccgcctccacataatcctgttccctggccgaaagcacatttccgtaaataagccttgcaaacttgggccagcccaggacgccgataactatggtaaccgttgccacagagggccccagcacggataccagcaccagaatcagcaccatggccggaaatgacatgaacacatccgcgcagcgcataatcagcgtctcggcaattcccctgtaataacctgccaaaagtcccagaggcacgcccaccgccatgctgataaccgcggatatgatacccacgctcagggatacccgtcctccgtaaataaacctggcaaagatgtccctgccgatgtcgtctgtccccagcagatgcagggcgctgggcgcagagccaaacatcacctcgtaatccgatgtataggggtccagatgaagtatgtagggcagggcaataaccagtatgatttccaaagtcagtacaaaggcgcttatcatggccggtttatgggcgcaaaatctctgaagtacgtcatgaaaataagaatttgccggaatatcctttaatctttcatcctgtttcatgttctcaccttccttcttcttagtcataacgtatcctgggatccagcagtccgtacaccaggtccaccagcaggttgcccaaaagtaccacaatggcaatcaccaccgtgatgcccataataacaggatagtccctggcattgatggactggaccatcaggcttcccagaccgggccagccgaatatctgctctgtgaccactgccccgcctatgaggaagggaatctgcatgccgaaccaggataccagaggaatccatgcattgcgcagcgcatggcgcaccagcaccgacggttcatgaagcccctttgccctggccgtgcgcacataatcatcctggagtacttccagcatggagcctctgcactggcgtatcaggcttccaatctgctggatggccagaaccacggccggaagcaccaggtggtggaagaacatgggccaggtcctgactccggaggtgtcgtacataccggaggtgggaaacagcttcaccttgatgcagaagaagtaaatcagcaccagtcccgcaaaaaagttgggcatagcggacccgatgaatgacagtcccgacgaaatataatcccagcctgagtagggcttataagccgacatgattcccagcggcagggcaatgatgatggtcagggccatagcgcttcccgtaagaatcagcgtggggcctatccgctccagtatcatatccagcacctgtccgttggtccggatggacattcccatgtttccctggagcagctgcaccagccatctgatatactggatgatgacaggctggtccagccccagttccctgctcttccttgccatctcctctgccgtggcataggggtcgttaaacaggatttccaagggcgagctgggcgccagggaagccaccacatacaccaggatggtgatgcctaagaaggtagggattgctgtcaacagccgtttcgcaatgtacctgtatcgttccatctgcatatcctcctcatttcaaattttgatgcggcagttcaggcaggcgtccaggaaaatgccctttctgaactgctgcattttgaaaaatccgttgccaaattttttatattggcctattataatattaaaagcgattctctccctccgcttattccaatgcaaaaggagccatacatggacaaccagccaccgaaattatcactaaaggacaccgtataccagcagttaattgaactaatctgccagggccaaataaaaccggataccctgttcacggaaaaccagatgatatcctacttcaaggtcagcaaatcccctgtccgggaagccttaatccagctctgccatgaaaatgtgctgaaaagcattcccagatgcggctatcaggtgacttccatcagcagcaagaatgtccgggatgtgacggagctgcgtctctacctggaactgtccagcctccccaaggtcatgaagaacatcaccctggccgacatcggggaactgaagcgccaaaaccaggtgcgcctggtaaatccggaaaaaaaggatttgtggatagcctggcgcaacaattaccagtttcacatgacagtggtgcgcctggcaggcaacgagcaggtaaacaatgccatggaacaggccatgaccacctaccgccgggcctatgcgcagctgtacaccctgaagaaggatgtgattgccgccaacaaggccagttaccacgacttttttgtggacagtctggaacggcatgacatgttctccgcccatgaatacctgaaaaaggatatcctgttcatggaagacgaactgctgggtaccggcatcacgacctgacggatgccggatgtacgccggctttatgccggatgtatgccgctgaattgccggccttagttctgctccagtttctccaccgagtccaccacacacttaatgcggtcataggcaatttctgtcggaagggtgcagtcagagccaacgatgaacggcctccccttcatttcctccaggacctccctggtatgctgaaggatttcctcctctgttccggttaccaggactccgtgcctgtccgggaacccgcccaggatgatgctgtcactgaaaagcccggcgcccttggtaaggctgtaatcatttccgtaaatcccccagtttacaatggccggatgcaaatccttataacggttaaagtcaatattgctcttgcatatatgtaacacattgaaatccgtgctctttttgatgtggtcgtacaccattttctcgtatggggccacgaattcctcaaattcctcatctgtaaagaaattccgctcccctcccagggccgcataaaagattccctccgcgccagcttccagggaacagtctgaaaattccataagggtttccgccactgtcctgaacacatgtttcatctcagccggacgttccctgcaaaataaggtaagctgatatcccatgctggtataattgcctgcaaaccctgtttcatggaaggtggaggcaataaggccgtggatggtagacataatgggatactctcccttcgccttgtcggcaatcctcttgataatttccatctggtcctggaaaatggcgtcctttctggaaaatcccctgaacttgctgatgtctcccagacgctcaatttttgtattcccatcatataggatattttcattcatgattttcaggatatccgtatccgttgccttcataaagtccagatgggcctcaatggctttctcaccatgatgcatgtcttccggaaaatgaagccagaatcctacaggtgtcctgtccactggttttccttccaatacatttctgatacgttccctctttgtcatggtttccattttgttacttcctttccctttttgatgcatgtatgtatcaattattctctccgttgatattatcaataatattatcagttaagacatatgtcaagtatattttgtattatttggacattattaataaattaattcatgaattttgtacatatattctaaacttaatatgttttataatattatcagcaaagggattattttcgaatgtgagaaagggaattttatggatatctacaaccagcgtattgcaaaagcaagaaatttaatgaaggacaccggcctctccctgttggttatcacgccttcctctgaccttatgtacctgacaggctactcaaaaccagccacggaccgtctgactgccctgctccttactgagcatgactcctatttcctgtgtcccgccatggagaaaaactatctggaggaggtggtctgccaggctgaacccattctctgggaagacagcggggacccgtttgtaaaaatggtttccgccctgtccgctgttggcatttccaaaaaatcctacataaaagcagccgttggaaacaggatgctcagcagctcccttctccggctcatggaactgtatcccggcattctgtggagcaatgcggaccgtgtcctgattcccctgagaaaagtcaaggcgccggaagagattgatatgattaggaaagcacaggatatggcagaaagggcgtttaccaggcttctggagcatggcctggaaggaaagacggaacgtcagctgtcagagcagctcatgaagctgcgtttggaagagggctttgacgcagtggggcccggcctgattgccagcggaccgggcagcgcctccccccatcctgtgctgtcagataataggatacaggcaggagacacggtaatgtttgattttggcgggacctataagggataccacgcagatatgaccagaacctgcgcagttggatatgcatccgatgaatttaaagaagtgtattccattgtcttaaaagcccacatggctgtcctgaggacagccgccccgggtacggcctgccgggatatggacctggccgggcgcagggtcattgaccaggccggctacggtgcattcttcacccaccgtctgggacacggcattggactggatatccatgagccgccctttgcctcggccggcggggaaggtgtactggaaaccggaaatgtgatttccaacgagccgggcatatatctgccgggacgttttggcatccgtatagaggatttaattgtgattactgataagggctgcgaatccctgaataccatgacaaaggagctgatgattgtgtgacgcgaatgctattccccttttttccacgccttgatttcctccagacgctcctttatcggttcctccgccccctggtccgtgggatggtaatattcccttccggccagtgaatccggcaggcactgcatccgcgccagtttttcctttgtatcgtgggcatatacgtagccgtcaccgtaatgcaggtccctcatcagcccggtgggggcattgcgtatggtaaggggaaccggctcagacagcatgtcctgggcatctgtcctggcggattcataggccgtataggcagagttggacttgggcgccatggacaggtaaatcacggtgtggctgagatgtacattgcattcaggcattcccaggaaatgacatgcctggtaagcagacaccgccagcgtcagcgcctggctgtccgccatacctatgtcctcgctggcaaaacggaccagcctgcgggccacatacagcgggtcctcccctgcctccagcatacgcgccagccagtaaacagctgcatccgggtcggaattgcgcatggacttgtggagtgcggatataaggttatagtgttcttcccccttcttatcgtacaaaaggctctttttaccgatacactgcttcagcacatcctctgtaaccgtggtcttatccgggctgattaccccgtttgtcactgccatctccagcgtattcagggcggtcctggcatccccgtctgcaaacccggcaatcatatcaaccatatcatccgtgatttccacattcagatagcccagtccttttgtgctcgtcagcgccatcttaataaggcgggccaggtcgtcctgcgtcaatgcctggagcacaaacaccctgcaccgtgacaaaagggcgctgtttatctcaaaagagggattctccgtggtggcccctatcagtataatgcttcctttttccacataaggcaggaacgcatcctgctgtgccttgttgaagcggtgtatctcgtccacaaatacaagggtcttgattcccattctccggctgttttcagcccgggccatgacctccttaatttctttgatgccgctggtaacagcgctgaaattgatgaactgggcattggtccgtttggctatgattccggccagggtggtcttgcccacaccgggaggtccccagaaaatcatagacggaattttgtcctgctctatgagctggcgcagcagcttcccccttcccaaaagatgttcctgccccacaaatccgtccaggtcatccgggcgcagtctgctggccaggggattgtatacttctctgtcgtcgaataatgacatctgttccatcaccttttacccctcctttcagaaatgggttgtgctgtaattgtaatgaatataaataaattggatacgattacgtttcactctgattttactgcatttcccaatcatccggaatattctccgttccccacttgcaaagcgactgcagaatcggcatcatactctgccctattgcagaaagtgaatattcaaccttgggcggaacctgcggatattcggtacgaatgataattccgctggtttccagttcttttaattggctgctcagcattttatgcgtcacgcttcccaatgcgcgttttaattcgctgtatcggagaacctcctttttccatagccaaaacagaatatgcattttccattttccgttaattaatgaaatggcatatgcaaatggttttacatttacctctttacaaaaatccttatctcccgccaccttaactctccttttagatagtatctatcaaaaatgtgtgttctttcttttttactataacacagtataataatattacacaatatcaaatttgcaggaggcaatttttatgagtttaatgaacacaccgataaaaataaaaaagattgaactaaagaatcgtctggtgatgccgcccatggcaaccgctaaagctgaccagacaggccaggcaacagagaagctttgccaatattatgacgaaaaatccagaggcggatatattggtttgattatcgcagaacattgttttgtaaatcaggagggaaaagccggcaacagccagctgtctgtttctgaagatgatgatatagagggattgaaaaaaatagcagctgttattcacaataacgatacacccgtctttgcgcaaatcagccatgccggcggagcgacccaaacagcaataaccggttgcaggcttttaagcgcaagttccatacaaatacccgggattaaaacacatgatatgctgcccagtgaaatgacgcaacgcgatattgataaagtggtgaatgattttgcaaaggcagcattaagagtgaaaaaagccgggttcgacggtgtggaaatacactcggcgcatggatacctgttgaatcaatttttttctccgttaacaaataaaaggctggatcaatatacaggaaatacacttcagggcagaatcagacttcatttagaaattatcagggctgtccgtaagcaagtaggcagttcctatcccatcgctttacgtcttggagcttgtgactatatagagggagggataaccatccgggacagtgtatctgcctgccaggaatttgaaaaagccggtgttgatttattagatatttcaggtggtttctgctcatatataaatccaacagtaaaacagcagggatattttagtgaactttctgctcccataaaaaatgccgtccgcattcctgttatccttacaggaggcattacagaagcagagacagcggaaaggctgctgcaaacaggaaaagcagatatgataggtattggacgcgccattttaaaaaactcccactgggcaaagcaggcagctttggccttaaaccagagcggcctatagagagcaggttaagattgatagtcagcaatttatagtgtattctataagaaagaggctggaatttagttttgaaaggaggaattgaatatgacaacatctaatataaaggttattatccaatgcgatatccataaagtatgggaaaccgtattagcagttgagcgttatcacacatggagaagtgatgtgagcagaacagaattgatagatggaaagcagtttatagaatattcccccaatggctacccaacaacctttacggttactgtggttgaaccgttcagacgttgggagcttgatgtggaaaacagccatacaaaaggtcactgggctgttgtatttgcgtccaaaaccagtgcgtccaatggcaatgaaacagaaatcgactttacagcgtgtgtaacagcgaaaaaactttcaatgagacccattggtaaaagcgtatttgaacaaacatatttgaaaaaagcgcagacgcaatttataacagatttaaagaaatttctcaattgacaactttcagttttgtataatatctaaatagtgaatgaccaggtcgtgtttgaagattgcttttacgtcagatgcgaggctcactttgcaggatatttggtcccggtgaaggaggcgtaatgggctgttccgactgaacttaagccaaatatatcgcaaagcggggtgtactttatcctaaagtggtcctaaggcgggtacctctggcggattccttaggacagacaatgaacttccaaatatgccctgattattaagtatgaagttagtacttttatattatgcgtaacatagaatacctgatttaaggatattaaattaaaataccatttttcagaatggatttgagggggctttcatatgaaaacgatagatgacaaactgcttgtattatctgacatcggacaggaatttaacagcgcaggggtcacctgggccgtgggcgcctctctattgctgtatctcaatggaaaaacagatgattttcatgatatcgaccttctgatatcagaaaaagacgtcccccgtgtaaaagaacttatgcagcaattcggcgccctgtctccaaaaaatccaaatgcgcggtataaaacaaggcacttccttgaatatacgatagatggcgtggatattgacataatggctggatttgttatcgttcatgacggaattgaccacgactgttctctggaccctgatacaattacatcgtcggccatggtaaataatgtctcaattcccctgcattcattagatgaatggtgtaagtattatgaatggatggggcgtccggataaagctgctatggctaaataaatgacagaggaataaccgcggaggatggcgtcaggcagggatggggttaatgttggggaagctgtattcctttgcgtggtgataaggttctgatggtaattggcttattacaaaaaattgtaaatctactgctcttcttatttcgatttgcgaggcccttgcgggcctcgacgctccaacggctggaggaggtacagaccgagatttcaacccacaaggccctcgcgggcctcgacctataaaaagtttatggaggagtatatggggaggatttcaacccacaaggccctcgcgggcctcgacagcaaatctgcctaacattccctccatcattttgtgtatttttcactttccctcctcaattccgcccttcgctccttctgccacagcccacacatccatccatctccccggactttccggtgcgaatctcccggacatttcatgtccgcctggcattcgcacctgcctaaaaggactttaatcccgtaaagctatacactatttatacagcacataatccttcatttcacgcatatatcctgcagtctgcaatacatcagctgcctcatccggatactctttcaaaacaatcctcttttgctccggatatatggctccctgcttaaatgcgcggacaaattctgttatcacttcctccatatcattagtattataaacgcggagcaccctgccctggcgttccattacggccgccggctttcctgccttcagagccactgcggttccggccactgccagaaatccacattcatccggaaactccaggacttttccccacaccaggtcagggtctgttccgtttagccacactgtatggttatccggctccctcaatgcacctgtcacggcatcataatcctcgctgcggacaaattgggctcctgacattcctgccacaaaatagccccttcttatgcgacccgtatattcccagatacgcagaacctccaatgcctgcgcccagctccactcccatttatttccatccgtttttaaggtatagggtgactcccatactgcctgtaccgatttccggaaggtttcacggcataaaatcatgttttcatcaaaaaacagctgcagccactcctccggcccatatttccttaccggccttacaatgtcccacctcccggccgacaaagccatgaccctggtatttacccgctgcctgacagcagctttcttcaccttatcctggttctgccattgtcttacaggcacaaagctgtccgcacataccaggcccttttcagccaggcttaacagtacttcctgggcgctgctttcctgtggtatctttgtaaggaatttaagaaaactggctcctctgcgttttaactcctggtacatgaggagctcatcccctttaagctcatcccctttaagcgcagcccctgttcgctcatctcctttgtcctcttcttcctctgctccggcagactcccaatctatgtcctcataactgcaaaaacagaggtttccttccggtgtcattctccagaaataatccccctgggccagcaggcggtccagaaggctgcctccgtagcgctccaccctcctggcaaaataaacattttcccagaaacggacagggaatggttttctgcatccttttgccattgcttcccttagctgttcttctgccggagcatgtatcactgccctggaagccatcagcgcggcgtaatgggaagccggctgcgtaactgtctggctgcgcaggctgcggatatgcccttctctggcacgttcatagagtttctcatgataatagacgcccttgtcttccactgtgctcccggaacagcacattttttccaaaagcctctctgccatttcttcagacaaaaaataccgttcccttatatcttccgctgtctgtccgccccggtagtaaagcatccgacggatgatatgcattccagcctcctggtcctgctgctgcaatgccctcatatactcgtcttcatgctctgccgctatccagattcccggctccacatagcaggccaggccctgtctggccagggtatccagccaatcagccggtatatccagctctcctgcttccaaatccccttccatcatgagaagagaatgaagctcctcctcattttccggcatctttctccttgcccatcctttggacaattcctcagccgtgggcttaagaagcgccttcttcaagtcatcctgcacggcctggcggattttaggagtcaccggagagtactcgtacatctcttctgcctctgcctgccactggaagggcagagacatgggagagggcacatccagccagatttccctgactgtaataagaccggaacgaatctttgccagaatttccatcactcccccaatgtcccactggtgttccagacattcccgttttgtctctcgaatcaggggatggtccggctggtccatcagggagcttaacagttccgtactcttaaggcgctgcatccaaaggggctgacgcccgccccgtttcatgcccatcattaacgcccgggctgcattgtagcggaatgtcatgccgaacagaggcgtatcaggcaggattgcttccagcaccggacgaacctggtccgggttaacttgatacaggagtccctccggcagctgctccctgccgtaaggatacagcagaaatccatcctcctcatccacacttcccacatccatccccatggtgtggcgtatcatatgacgcaggaccagggacagcgggccatttacccgtctgccaaacaaagcatggaccatgacctggtggtttcccgcgctgtctttaaaatgttccaccactatggtcctgtggtcaggaagcccctccgtggcctgaatctgccgttttataaagccggacgcattggccgacgccggctcgtccagtcccagttttcccagggccttttccagttccccggcgcggctagccatttccagctctgcgaatatccggccgaaggcaaggctggtcctgaggtccctgccctttgtctcccctttccaaaacggaagtctggctccctctgccggagcctgggtcacaatgactgagtccttatcctggcggaccacacgccagccaaaggaccccagcatgaaccggtccccgattctggactcatagacaaactcttcgtccagctctcccagcttcaccccatcctctgttttagctgcatacatccctttatccggtatggtgccccctgctgccgtggccagcatacggctgtaaacatcccctgacacccggccatgaatccggtcatacagaatccttggacgcaccggtatttcccggttgtgctcatagtctcctgccagcatggcaaggacatcctccacatcctttctggttacctggtaaaatggataagcccgttccagcacttccatcacatcatcaatgctgtaactttctccggaagccatggataccagatgctgggccagtacatcaaggcacaggcgcggaggatttgcccgttccacacctccatggcgggccacctctgccgtcataccgcaatatacggcctcaggcgcggtcctgggatacatgtacataacgctgaccctgcccggattatgtcctgcccggcccagccgctgcatggtgctggatatggtacggggacatccgacctgcaatacctgttccacatcccccacgtcaatgcccagttccatggacgacgtggcgcataacagcctcagtcttccctctcttaaatcccgttccacttcatcccgctgttcctttgacagactgccatggtgaaccctggcaaatccatccccgcccagcagattcacataataagccagtttttccacgtaacgccttccctcagaaaatgcaatcacgctcttacagctcagacactgacggtataccgccatgcccagttcttcccataccgggtccttccttcttcccacggcaggagccgtgccaatgacctggatttccacctgcttatccatggccggggcacaaatggctgcaggttccggtgacaggtaggaggctgcaagctccaacggttcaatggtggccgacagtccaatccgctggagcctgtgtccgcagagcttatccagcctggccacagacagcatcagatgcgctcccctcttggtatcaataagggcgtgaagctcgtccaatatgattgcctttgcagtctttaatacctgacggccggatttggatgtcagcatgagatacagggattccggtgtgataatcaatatatgcggcggatgctttaccatcctctgacgctccttctgaggcgtatccccagtgcggatggctgcctgaatctcctttatggattgcgtgccggcactgcctcccaatgcgccggaatcatctgccacaccggattccgcctcaatcccctccaaaggtttacggaggttttccctgatatcccctgccagagacttaaggggagagacataaatcacgtatagttcttccctgagctcccccttctccgccagtctgcccaactggtcaatgaacaccaggaacgcggagagcgtcttgcctgtaccggtaggcgcgctgaccagcacatgctttttatcggcaatggcaggccatgcttctttctgtatttttgtaggttctccgaatgttttccgaaaccagctttcagtagcaggcaggaattgtttaagagtatccttttgcatataatcctccatgcaggcggctacgtgtcatttctgttgtctggattcttacccggaaaactccgggtattcatattattataccattctcctcttccgcctgtctatggcctgcatgccggttccgtctatcatttacacggcatcctctccccgctgtcacttacatgatatccccgcccttctccatgctatttccaaatttttattttccacctgcacaggttcccttcacctcaaacttattatataatatgttcatatcaaccataaaacaaatcaaagcgcactggaaaacagctcagataaagcactggaaaggaacagacatggacaaacggaaaaccggcatttttcttctcatattcctgcttgggctcatatccggctttacactatccagcgcagtcagaggacatggcattgcagatacttctgcagcgcatgacgcctctgaagcacatgacgtttccgaaacacataatgtctctgaagcacataatgcctccgaaacacataatgtctccggttcccctgtccctcaggccctggtgacctccggctgctcctatcccgaatgggacaaacatacaacctatacaggcggggacaaggctgtctatagcggtaaaatatacaaagccaggtggtggaccctgggagagattcccgggcaggccgatgtatgggaatacacaccggaaatgcccgcccagccggaagccgtgcgcaaagcctcaacatcctccgcaaaaatagtgggctattacccttcctggaaatcctaccagccccaaaaactgcagatggatgtgctgacccacatcgcctatgcatttgccattcccacatccgacggcagactgcttcctctggaaaacccggaaacagcaatccggctgatagaatacgcccacaaaaaccaggtgaaagtcctattggccgtgggaggatggagccataacgggaccgaactggagcctgtatttgtaaacgccacatccaccagtgaaaaaacaagacagctgggcgatgaaatcctggccatgtgcagccaatacggatttgacggagtggacatggactgggaacatcccaggatggacggcagctccaaggaccaataccaggagctgattctttatctggctgataaactccatgcacaggacaagcttctgaccagcgctgtcatcagcggcgtcagcgcggacggcaatatctgctacgatgcagctgcccacagcgatgccgtgctggaggcagtggactggattcatgtcatggcctatgacggcggtgacggtgagcgccattcttcctatgaatttgcagtgaactgtgccgcctactggcgcggcgcacgaaagatgcctgccgataaagtggtgctgggcgttcccttctacagccgccccggctgggccggatatgaggatattctggcggcagaccctgatgcctggagcaaagaccacgccctggtcaacggggtggatgctttttacaacggcatttccaccatggaaaaaaaggccgcgtatgccagggaaaacctgggaggaatcatgatatgggaactgacccaggacacggacaattctgacaaaagcctgctgtcagccattaaaagaggaatgcagtaacccatctgaagacgtacagaccagcaaaaagggctgcccatacacatgcggcagcccattccatacagccatctttctacgccagcgggttataaggacatttttccttcaggcactgttggttccgtccatacaatccgcacactatctttccgggacgctccatccgtatcccgaatttctcctccacaaaatcaattgcctgcaatatggctgtgtaggaatcccgtttgcagcatctgggaccgcctgttttggcaatggctgcaagacttctggatgtcatttcattgcaaagcccccacgcttccccgcttaagggagatgctccggtaatcagactgatgaaaatgcctgtacttactgctgccccgcaggtcccccacagtccgcagatgccacccgggacctgtgctcccctgtttctcatctcttccaaagccccatccaaatccagctctccccctgacttcttataggcagccaacagcgcggagccaaccagcacatgatgttccggaccgtgcatatagatatggggggacaggatgattttcttcatgattgccaccgggtccctgctggctgtatgcctgcatatatcttcaatcacccgcagtccaatctgttcatgacagctgtcacagataaaatgtccgttcacgcacctggcattgctcataaacttcctgcggcagtaagtacattccatctcaatctgagttttaagatattccaaaggcgcaccgcataccagacaccccgccgcctgctcttccactgtcccttcttccgctgtcccttcttccgctgcctgttcttccgttacctgttcttccactgcctgctcttccgctgcctgttcttccgctgcctgctcttccgctgcctgttcttccgttacctgttcttccactgcctgctcttccgttatctgctcttccgttacccattcttccattatcatatcctccgattaaccaatcaatttcttaatccggccatcttaaacccattttacaagtcatatacccataagataactccatcccagtataccataaaccatggtcctgttaaatcccaaaaaaagcataaaccgatcctttccggaaccggtttacactcttttcctcattgtttcatatattctacaatggtttcccttatcatccctctgttttctactccctgcccagggtagcccctgaccgggccgtattcaccaggcgggcgtaccggcccagaaggcccttttcctttggccgtgtgacggccttccactccctgcgtctggcttccagctcctcgtcgctgacctccagatggagataatccttatacaaatccacggttatcctgtccccgtcctttaccagggcaatgggaccgccctccgccgcctcaggacacagatagccgatgcttaaaccgccgctggcccctgagaaacgtccgtcagtgatgaccgctgtgttgggaattcccttgatgatttccgtaatccggtgcagttccttcatgcccggaccgcccttaggcccttcatagcgtacaatgacagcatcgccttcctttatctcctttgcccggaatgcagcatagcactcatcctcgccctcaaataccctggccgtgcccttaaaacgccgcacttccataggcaccgccgatgtctttaccagcgcgccctggggcgccagattgccgtagagcacctgaattccgtccgccctggatacaggctcatccatggactttatgacttccctgtctccctgaaccgtgcgcgcaagaacctgccccagcgtctcccctgtcacggtcagcacatccttatgcagcacagactccagctccttcatcacagccggtattccgcccgcacagtgcaggtctaccacagtcctgtttccgttgggtacaatggaacagagtaccggtgtggcggtggtaatctttgagaaatcatcccagtccagggaaatccccagctctgccgccagcgccggaagatgaatcagggcattcagggaccctccgatggcggatagaagggtaatggtattctccagcgcctcccgggtcataatctggctgggacgaatctgtttctccaccatattcattacagcccgccctgactcccttgcgctgaaacggcgcatactggtgctggaaggaatcaggcttcctcccggcagcatcattcccagggattcgcagagggcgcccatggtattggcggttcccaggaagggacagattccggggccggtataatacttgagcgttccctcaatcagctgccgttcagttatctcgccccgcaggaactgctggcgcagctccttggactcattgggttttatctgggcgtagcagggaccggctgtgacgataacggacggaaggtcaatccttgccgctgcattcagcattcccggtacgattttatcgcaggagcccatatacaccactccgtcaaacactccctcgcccaccaccatggcctcaatggaatccgtgatgatttccctgtggggcagacagtagcgcataccggagtgcccctgggcaatgccgtcgcacatggccaccgtgttgaactcaatgggttcgccgccggcttccaggattccctttttaacttcctccgccagctgttttaaaggttcatgtcccggacatatctcattccagctgttggcaatggcaataaggggcttgtggtccagggaatcaacggaaacacctgccgatgccagatgggccttggatatagccttctggaacggctccaatttatcaattgctcgcaacatcatttcctcctgctaaaactgctttcttcttgttataccggttcatgaacacccatacggcagccataaccgcaatcagcaccggcacggagataaacggcctcttgataaatgcctcgtataccagaaagcttaccgtaaggctggtagctgcaaaggatgtaatcatgccctctcccaggtccagtcccacggacgtggccagctgggtcagaaccggtgccgtggccgtacctgccagcaggatagctcctgtacataccagacccatgatgatgttcttaaacagatttcctctggtgattgcaaccaccagtgccacacggaaggttacaactgccaggtctgcaaagggaagcacgcggtttcccggaagcacggctgccataagaatggtcagcggaataacaatcagggacgtggtgataacatccggatttcccactacaaccgctgcatccaggccaatgaggaatttcctgcccttgaacttctcctgggtgaacttcttggccgcctctgagataggcataagtccctccatgaaaagggaggtcatcttgggaatcagtaccatgacagccgccatgttcacacccagggccatgatgtcagccactgaatacttggccagaataccgatgacgcatccaagcaccagtcccatgatggtgggttccccaaagaaacccagatattttttcgcatccttgatttcaaaattaatcttgttgattccgggtatcttatccaacagccagttaagcggagctgcaatgataatggaggacagggccgacatggttggaagggatacgcccggaatgccgaagtaatcctccaccagaggcgcggtccagtctgacagcttgaatgtgatgatagccatgataacggttgcaccgattcccattgccacattcttcgtcacaaaataaaccatgattcctacaattgccatatgatgataattccagatatccacatccagggtatcggtggccttcagtaccagcatgacgatgttggtggccaggatacagaaaataaggatggcaataatgggtgatgaccaggtaactgctgcaatggctccccagcccacatccagaatatccagcttaatgccgaaattctgcaccatggcctgggctgcaggtcccagattgctcttcatcatgttgatgaccaggttgatacctgcaaagccaatgccgatggtaaggccgcttctgaatgcctttgacaattttacacggaaaataagccctatgatggtaatgatgattggaagcatgaccactgcgcctgcgtccagaatcgtattgaatatattataaagtatctgcatatgattaatctcccctaagatttcatttgtctttcatagccagtgacggtcttcctgaacccttttttatttcagatgggacagaatctcatccagcgttgcgtcctcgttgattcctgtgagcagggaaatggcgcctaccaccgggatatccacattgccgcctgtaaactttccggtggtaaccagcaaatcaaaatcctctgccttggattccacttccagaagcttgcactgggttacggataccggaattccgttatcttcacatttttccctgattttggttgccactacggttgatgttgcgattccatttccacatgccactaatatacgtttcattttgaattctcctttgataatctgatttttagttttcattttccaacagatactgcttgattatttgatggatggtgtcaggctgtcctgcctccacgatgaacttcacatcctcctggttctgtatcagcttcacgattctctgaagcatctcaatatgtccatgggcctctgtcagggccagcataataaccaggcttaccggcacgtcattgtccggttcatccatggcccggaaaggggccggtgtcttaagcacagccacgcagatggctgcctcgttcacatggcagatatccgcatggggaatggccacattgattccccctgtcttaaggcccgtggggaaggactgctcccgttccagaatggcctttttgtatgtatcctttacaatgcctttttcacaaagataatctgtcatggcggacaggacttcccggtccgtcataggtttatcaaattccagaatcaatgattcattaaatgcaatagagctcatgattctttttcctccatactcttcattttctcttccatggctgctatggaactgcggattccctcttcattctcattcagaatgtcctccttccggaagatgcctgaaccgattcccgcaaatgacgcccctgctgcaaagtactcagccacatttgcggttccgatgccccctacgaccatcagcggcattttacccaggggcgcctggatatctgtcacgtatttgcttcccagcctgccggcaggaaatattttcacgatgtcagccccatccagaaaactctgcctgatttccgaaggtgaaaaagcacccggcacagacaccacgccccgttcccggcacaggtccaatatacgtttttcaaataccgtaggcgacaataaaaaggctgcacctgcatcaatagcctccacggcttcttcataggtaaggaccgtgccggctcccaccatgatttgtcctccgaattcctggctgattttccgtatggattccagggctcccggagtgttcatggtaatttcaacggagcctaagcaggtcccggccaggttcttgacaaccgtgcgggtctgtgaataggtatagcctcttaagattactgtcactttcggaaatttctctatattcatcattctcgctcctttctgacattatataaagcaagaatgatgccaactaattgactgattttgtatttttacataaaagattccggatttcttcccgtgtccggctggcgcgtatggcagaaaccatggattcatcagaaataatctgatacagctgttcaaaatattttttggaatcctcctgaatcgccagcacaaaaataacatccaccgtgttgaccccatcccacaaaacgggtttgtctaattttgtaacggaaatgactggttttgtaaccaaacccgggtcgccgtgggggatggcaattccctggctgagacgggtggtcatcattccctcccgcttgtagacgctgagcaggaattcctgcctgacaaagccttcctccgccatgtgtcccactgcctggtctataatctggtccttaaactccgcctctgtccttatatagatatggtccagggaaatgacctccgacagctggttttcctcaaacatggcgctccgcttcaatatgctgcggagctgccggatgccctcggggctgtaaatccggcttacggatataaagggatatgcctctgaatccggattgatggtgcccactatggccaatatctcatattccttttccgtatttgcaatgatgcgctcaatgctggagtcctcaatatagcccctggtcactacaacagtcccggccagattgcttttcagccgttccgtcagatgctccttcagtttcaccgcagctccctggcccgttatgcacaggcacagaatcgcctttttcctggcctctgtctgctccctgtttccggtgagcttaatcctgtccagctcgtccgctatctcgttcagggattcatccgtccacatggtcttgcgcaccgcctccaccaccatcatggtgtctgtgcgtgacagcacgcggacctgcatacctgtctcctcccgaatcttttgtcccacattcaggagggaccccatatccgccaggacaatgcagccttttccctggttaatgcgcctggccatatccactgtcttttccgccatctgggccggcgtatcccacaggttcatgtccacgccaactgcatgttccgtacccatgatggcgttggcgacctgggccattccgctggcaaccggcccatgggacaccaccagcacagcaattcttccctcctgggccgtgtcttttttcctgaattttctgaagtacatggccagaaagcccttctcctcctcaggcagggacagataatactttttctgtatttcatccacagcatagcaggctgcctcataatcctcatggtactgctggcgtatgttctccatgccgggatacaccatgcgtccatggccccgcatccgctccatggccatgttcagatgaatggccagtggaaacaccacctgttcctccagccccggaagccgtttcctggccagctggcagatatcccttgtcatacgcaggatgtcatcccccacaatggaggctatctcgtcctcccggatacctgacttctggaattcatggatattgcgctggaacctggactctatctcatcggtcagctggacttcaatgtcctggtccctcagaccggaccttaacagctggtcatatttttcctccagggattcatatatgttaaagccctccagaaatgcttcggccctgggttcccccgcatgttccccggaatcatcgggaaatacatagcagtcgtccggacacagctcccttatctccttggtaatccggtcaggcacatacccttttctcaggttctcggtcaggcttccgaacgaaaccgtaatccggccgtccttcctggcccggccttccagaaacgccttggcgcagcacacctggatatctgatttcagctgtcccacattgccgggacagtcaccggacagcagacaccaaagggcctgctgcctgatttttatctgcttccccagacgtctggattcccactggaaaaaacgcaggataaactgcagcttctctcccgcagaacggtccttcaggggcggaatctctatgaccatgggaatcctgcgcctgaaggtcaggagcagggagctctggggattttccgtggtcgcggcaatgaccatcacatggctctcccgctgggtatccacttcccccaaacgtctgaacctccctttatccatcaggtaaaacaggatttcctggccctccggcggaagcctgtgcacctcgtccagaaacaggattcccccgttgcacagctccaccactccctttttattgtcggcagcccctgtgaaggctcccttgctgtatccgaagagctgggccagaagaagctggggattatccgcataatccgcacagttaaattcaaaatacggggcatcctttccgaaattctcagtgccgcaggcatactcatgcatgagttcggccagaaagctctttcccacgccggaaggaccgtatatcaggcagtggagccctctgggagggtacagcactgctgcctgggcgcgggtaatctgtgtcttcatgcttccgtcaaatcccacaaaggcgctgaatgcagttgcccggtcatcctcccatgcggattccgcatgttccccatattccggcgacgggtctgtgttttccttgtcccggcagacaccggaaggagtccatatccccaaaagttcttcccgcagcttacccgcggcgtattttcctatcttatagccagcatcctccagcatcctggtaagcccccggtccgacaggtccggatgttccgtgagaatccgcttcatatcttcaaatatgaccggtttcctccgcttcctggaatcagggatatggtgttcccggcgtactgtggtcacatcctccctgaatacctgcaggcgggacgctatttcctcgtctgtcaggggattcttactgtcctcatcttttatgatttgcaatatctgttcttccatgcgcgcactcccctatacaatcgtgtggcctatgccaatggttattatcataccatcttttgatatgatttaccacatggcaatccaattggtacaacacccctgcatcccctatccgttcctgcattgcagcgcccgctaccgaaagccgcttacacagtgccgggccagacattcctccaaaaattccacacaatactgctccagatgcttcagcccttccttttctatgggaaaatggccggctccctttaacagcttcatctccttactgcaattcagccggtcaaaaaacagcctgctgagaccggcatccgtccatctgtcattttccgggtgcaccagaagcaccggacacctgcggaaacgctccggctccgggtggatgtcgggattcaaaagcgtgtgcagaaatgctaccggcactcttgctccggaagcccgcctgtctttcatcagcacctccgccagttcctcatgatttacaattgccttcatattccccacccacttcataggcacttttacaaagcccaatcttgcggatgcttttgttatggctctcaggccgtggtctgccatccatctggaaccggccgtgcttttacggaccgtcggatttctctggtccagaagacaggtggctatgacgccctgaatcccgggcagaccggatgcagtctgatatgccaggattccccctgcgctcagaccaaacaaaaaggtggggcttatctccctggtctgataatacatgactatctcggccgcgcagtccacccagtcctggtacaccaccgttccatagtactccgtcatcccatagaggggaaggtccgggcatattacctcgtatccctgcttcatgagaggcaccgctatgaacgacagaagccttccgttccctcccacgccgtgaaacagtatgattcgcgcctttggttcctttaccctgtaatggtctatatgtatgccaaacctgccaatacccacaaaatattcatccggcagacaggcctctgtcaggcggttttcctccggcaggtattcctgcactttcttccagtatccatcttttccgtaatacatgtgtgtccctccgctttgcgtcattgctatttttaaaccatgggccggatggggtattgctgcaacgcaaaaagacatagcctgcaatcttgtataagatgcaggttatgccctaaatctgccggtgcataatcctattttattatggttgcaatcctggtttccgtcgctgtcagcgtcgtccatccctattccaagctccttttgccaatccctgatacagctttataaaacagccgtataaaaaatagtctgaatgcagatgcctctacattatgcagcattatacgaaataggcaatggattgtcaatgttatactctgaatcttaacaaaattttaattctatgtttgattcccatgctgatgtccgccattttccggacctaaaaccacttttttgtttccctacagataatgaggcgtctttggcgtcagcacctcacagccgtcctctgttatcagcaccatgtcctcaatattaaatccgttgactccccgtatataacagggaacctccatggccaggaccatgcccggctccagaagccgctttgtggaggcattgatatatggttcctctgccgtggcaggccccaggctgatgctgtggccgcagtggccccttctgtaacagggatactgttcttttacatactcataggcagtccggaacaattcacagatgggaagtccgggctttgcagccgcaatcatccttctctgcccctcatacagacggtccttcagccggaacagctccggggcagcatccttcatgacccaggccctggatgtatctgtggtataaaaatcaaactccgcattgaccccggcgtcatacttgaccacatgggtgctctctatgaccccatcctccggaagcgtaagcctggctcccgagggcccggtggagaacatggaccatgggctgggtacgcagataccggaggagatgaccgactgcctgaagcagtccgacatttccttctcccttacccccggctgcaccatgcggctcacctggtaaaagccctggtccgcaatcccgcacagggtacggaacatctgtatctcatcctccgccttcacgcttctggccagcacgaacatagacgatatatccacaaaccgtacttccggaaatgcctctttaagctgcctgaaatagggcacattcagatactcaagctccacgcccagcgttttgtcagccaggtccatgtcctttaccatcttcttcagcatatcaaaggaggattccatcaccggtttatcaacagtctttccggcacctgtgatttcatcccatgtctttactcccacccaggtatcataggggcgcaccacaaactccggggcgtccttccccaggctttccttctgttcccttacacgcttttcaaatgtaagttcttcataatccatggtagtgagctgggttgccgccccgtcatccgcagacatgactgccagtgcaaagccgggctgccgggaaaccgtgtgctggtgtcctgcaaaccctgtcacatagtggaaattttccggagatgacacaatcgcgccgtccaggcccctttcccggagcattgccttaatccggcgctcctttggttttatgactaccttctcaaatttcattcttctgcgctcctaactgcaggtggatgctggttaagctaccggcccattttcctgtccacagctgcctttaactgtcccaatgccctttcgatggtcgccctcggacacgcgatattcatgcgcatatagccgtctccctccggtccgaatccccgtccgtcgtttaaggcaagtcctgcttcctccaccataaatgcctgaagctcatcccctgtaaggcccagtccccggcagtccagccacagcagatacgtgctctccggcttccggaaatgaatctccggtatgttctccttcaggtagctccatgtataatcaatatttccctccaggtaatccagaagctgctccagccattccccgcctttcctgaatgcggtttccactgccaccaggctgaagcagttgttgcggtgcacgtccatgccaaaccagaatttctcatacctgtccttcatctcatggttcgggaaaaacagggtggctgcctgaagccccgccaggttaaaggtcttggtggccgaggtgcaggtgatggtgatgccggcaatctccctggaaatccccgccataaccgtgtggcagtggccgtacagcatcaggtccgaatgaatctcatccgagataatcggaatcttgtatctgaggcatatgtcccccaccttctccagctcctcctttgtccaggagcgtcccaccgggttgtggggattgcacatgattaaaaggccgggcctgcgctttgcagcttcctcaaaggcttcgtaatcaatttcataatacccgtcctgctcctttaaggaaaccgtcagcggcgttctgccgctgttcacaacggaatcatggaactcagagtaaaccggggtaaaatacagcacctcctggcccggctccgtgaattcacggacaatggtacagatggccgggataacgcccagcgcaaaggctgccaggctcttgtcaaatacatggccgttgcgttcctcctgccactggcacaccgcttcataataggaagcaggacgggtggtataaccgaatatgccctgcctgttcctctcctccatggcgtccatgatgggctgcgccgtcttcaggtccatatccgcaatccacatgggaatcaggccgtccctgccgaatttcctggcgcactcatcgtattttgcagagaaattacggctgcggtccacgggttcatcaaaattatatttcaattggttcatcctccttttttacaattcacacctgctgaaatggccagggggagccccctcccggaccgcccgtgccggccggccgcagggaaggaatgctcccccttatattctggggcctgtctgaatattcattatggcctggagcctgtctgaacattcattccagccaatgcacgccctagttcttcagtcttgggtccagagcgtccctcaggccgtcgcccaccagattcagggacagggcaatggttgcaatggtcagtcccgggaacaggacgccccacacggaatagcgcatgtactcctttgcatccgaaagcatggagcccagttccggagccggaggctgctggcccagccccagatagctgagggccgccgtattcagaatctgcgccgccacagccatggtggcctgtactataattgttcccactgcgttgggtaatatgtgccttactataatgaataccggggaacagccgtatgccttggcagcctctatgtactccatgtccacgatattaaataccgcggaacggaccacccttgtaaaccccggcacctgggaaataatcagcgccagaatcaggttgcggataccggctcccagggacgctgctatggcaatggccagaagcagtgtgggaatgcccatgaacacgtccagtatacgcatcagcaccgtgtccaccttgccgccgtaataagccactatggagcccagaaggcaggcaatcaggcaggccactgctgtggatacaatgcccacggtcagggacaccctggctccgaaaagcacgcgggcaaagatatcgcggccgtaatcatctgttccaaataaatggtgcagggaaggtcccaggaacctggcatcgtaattctgtgtaatggcatccgcctcatagtcgcagataaccgacgcaaaggctgccagcagaaccacggttacgatgatgacaaagccaaccatggccagcttgcttctgcggaagcgtttccatatttcagccacacggctctgtttcttcctgtctttcttaactgcatcaggctgcaggttgtcgtttggcacgtctaacacctcctacatatttggctttgattctggggtcaatgtatgcatataaaatatccacaatcaggatgattaccacattgagggctgccaggaacaggatgcaggccgttgtctggggtatgtccttggaccggatggacgtgatggtaagggagcccagtcccggtattccgaatatggattccaccagcacggtgcctcccagcaggtagccgaattcattaccaatgaccgtgataaccggcagcagcgcatttctgagcgcgtgcttgtagataacagtgtgttccgatgcgccctttgcccgcccagtccttacatagtcctggcgtatggtctccagcatgttggaacgggtcagcctcagtatgctggctgccgtggccatggccagggtcaccacgggcatgatgaaatgcttcatggtgaccacgcctgtaaaggtagagggcagaaggcccagcttcagtgaaaacagcatgacaaacatcattgccagccagaactggggcaccgcggcaaaaaacatggcggatatggtactgataaaatccaggcccgaatattgccgcaccgccgatatgacgccgatgggaacacctatcatcactgccaggcagatagaaagcacacctatgcggaatgtcacgccaaaacgggaaaagatttcatcaaatacaggctgacgggttctgtaggaggtaccaaagtccccgtgaagggcatcctccagatagtgtacatacctcaccacaaacgggtcgttcatccccaattcttcatttaacttatcaatctgctcttttgttgccgatgttcccaggatagcagacgcagggtcacctggcgtaaaggacatgataccatatacgatgaacgacacgcccagcaataccggaatcatcagcagcaaccttttcaaaacatatttaatcatagatatgcttcctttcagatatcggtagttcagacacccggcttaaaacccaccggccttaattccaatgcatatcgcgaagggttgagaaaccggaatcataggacctgtctaccgtgactcccttattgtatgcacatgtaaccacacggtcataaatcgggataataattgtatcttcgtacagcttcttctctataacagagtatatatcctttctctgctccgggtcctgacatacggaaccgtcctcaaatgccttgtcaacctccgcctcattgagcctggagaaattatatccgccaatggcgctggacataaatacagtgctccagaagtccacatccgggtccatggtctgtacgatggtggacatggcgaaattaccggacttcatgtcggaaacccatgtattggcctccagctgctccacggaaatattcacgcctatctgtttcaactcttcctggtagacaacgccaatcttcttatagttttcatagccaaccacaaaggggatttcctctccattgtaatctgtctttgccagatactcttttgccttgtccagattgaactcaggcgttgtgtacttgccggagtaacccgctgtcctctcatcccataacaggctggacaccttggcaacgccgtccatacccacttccacgatgtgttccctgttggtggcataggccagggccatacggaagttggggtcatttaagaaaggagcttccagattcatgacaatatacccgcttcccatggttggattcaagtcaaggaccaggtcctggctgctctgcagttcctgcacagcgattggaggaatggtgtatgtcatatcaatctcgcctgtctgaagtgctgtaagggctgtctccggattggtcagcactacaaagttggcttccttaatctggggcagggcatcgtggtactcgtcaaaacgctccaggacaacctgggagcctgaatcccactgtttgaatttataaggccctgtgcctaccggcatctgcctgatgttgtcgccggcctcatttaccgccttctcattcatgatacagaccgtggaggccactgctgtcaggaacggcacatatggctggtccagaacgattttcactgtcaggtcatccactgcttcagccttgacgatgttctttgtgaaattggacatctcgctggaatcctttgcccgcatcatggagaaaaccacgtcgcctgctgtcagggtttccccattgtggaattttacgccttccttcagattgaaggtatactctgtgccgtcctcgctgatgctgtaatccttacacaatacattttcataattgccgtcataatagcgcagcaggcagtcaaagatgttgctgtacaccaccttgtccaggtccatgccgctgttataggggtcaaatcccgcaaagtcggaatagacggcaatcttgatggtgtcctttccgctttcctgggtgcctgcatccgccgctttctcggttcctgcgcctgcacctccccctgaactgctccctgaacctcctccgcatccggctatggtaccggctgccattgcgcacactaaaagcatgctgattagtttcttcttcatctgtttacctcccttattttaattaaataatacacatgcaacctggtggttctctgaaacatttttcaaaggaatatcatgacccatgcatttttccgttgcccttggacatctcggcgcaaaacggcagcccggagccgggtcaatgggactcacgatttctccttttatgctctgtcttttcctgttcctgccctgaagcctgggtaccggtatggaatccaaaagcgcctgggtataggggtgaagcgggttcttgaacaattccctgctggaagccttctcaatgcactggcccaggtacatgaccatgatttcattggaaatatgctttaccacagacaggttatgggtaatgaacatatatgtaagccccctctgctcctgtaaatccatcagcagattcagtatctgcgcctggatggaaacgtccagggccgataccggctcgtcacagacaatgaacttgggattcagggacaaagccctggcaatcccgatacgctggcgcctccccccgtccagctcatggggatatgcattgtacaggcgggaagccagtcccaccgtgtccatcagctccgccacccgcttttccacttcggatttcttccggcagattttatttaccatcatgggctgccctatggtctcgctgaccgtcatacgcggattcagggacgcatacgggtcctggaaaataatctgcatatccgtgcgcaggttctgcatatcctttctgccgcactttaatatatcctttccgtcaaagagtatctgccctgaattcggctccgacagcctcagaatggtcctgcccagggtagacttgccgcaccctgactcccccaccactcccagggtttgtccctgcagaatctgcatgttcacatcatccactgcgtggagttcaccggcaggcgtatggaaatactttttcaaagatttcgtctcaagtaaaattttattatcagacatgccaatttctccttataccttgtcctgccatcctggtttgatgccggaatacggcggacagacggcgggaatgaattatcaaacgcgttcctggccatcctggtacaggtggcaccgaatcatatgggttccctccacgcattcaggcggctgggcactcttacatatatccatgcatttggggcaccgtggatgaaacttgcagccccggggcaaatccgtggggtcaggcatcagcccttcaatggggttgagtctcctgctctccacctccaaatccggtatggaaccaaaaagtccctccgtataaggatgtctgttctttccttcatatatatctgccgctgtgccgtactcaatgatttccccggcatacatgattgccaccttgtcgcatatctcagccacgattcccaggtcatgagtaatcaggatgatggaagtattgattttctccttcaattcctgcatcatgtccagtatctgcgcctgaatcgtcacatccagcgccgtggtaggctcatcggccagcaaaagctcaggcttacaggcaagggccatggctatgaccacgcgctgcttcatgcccccggaaaactgatggggataatcctttttacggctctccacaattcccaccagcttaagcatttcctcaatccgttcctgcttttcctcaggcgtcaaatccatgtggagttccagggcctccccaatctggtttcccactgtaagcaccggattcaggctggtcatggggtcctggaaaatcatggatatcttttctccccggaccttccgcatgtcctcctcggctgctttgaccaaatcctccccgttaaacatgatttccccgccggtaattctccccgacacctttggcagaaggcgcataagggacagcgccagggtggtcttacctgcaccggtctcccccaccaggccaatcgtctcccccttattcagggtaagggatacgtgattgactgctttgacaatgtcctcgtccgtcgtgtactccacgctcaggtccttaatttccaacagcttttcttccataatccagctccattctgtttttatcttaattaaagccctagcacaacgctgtactagtgaagataatcctttaacatgttcatggactgctcattgattctgtcccacatctcatacaccggaatcttccagtcacactgccggaccttctccgtcaaatgagggcttgcacagataaccgatgccttttgggcgattttcttccactcgctccttttatcctcgtaatagacttccacatccaggtcagggcacattctgtgaatcaggttcacaaagccgtccgcggactcctcctttttacagataaccgctgccacagaacctgcttccagggattgcagcgcatccatcacatccggggcaacctccaccgtcataccgtaaataataggctggtagctcctggctatgcttctcacctgggcatactgaaagtaggtggtaatgattgcatccaggtgctctatctggtcccggtgctcctccaggtaatcccgcagctggtccaggtggacctcctcaacctgcacatccgcctccctggcaatctgcatggcgaaacggtggccgatattcttatcctcataaacaaaaatcacactttttttcttgctctcctcaatctccttcaggaccttgtccacaatgctgcggacctcttccacagacagctggtagtagatggcattcttaatggatgtgaccagctcctcctccagctttttcttatccatggactcggtctgcacaatggttcctatatgcggtctggtaaccaccagctcctgctgctccagacgcttataagcattgcgcaccgtattaatgctgattcccagctcatcagccagtacgcggatgggaggaagcttttccgtccaccgcacctcgccggtaaaaatgctccatctgatattcctcaccaactggtccgtgtatgggattttagagtccttgttgattttccacacttcggcatattgaatcatagatattccaattgtcctttcttcctgttgggcaacatatataatgtttgattgtttgtttctattgttactattgtttctatcacaatgtcaatatagcatactttttaggctttgtaaatatgtacatattttagaatatatcggtatatttttatgcattatttacatttttcggcgtttgataactttatttgattggtatcaatgttattttggctgtttgtttggtataattaaaaaatgacgtacgttctctccacttatcatttcagactgaagtggggcgaaaaaggtatacggaccgatgatgcgcatgcgccagcggttttgacagggcggacaaaaagcaaacaccgggagataataaacaaacaccgggaaataacggccccgtcatccgggcctcccggtgttcttccctgcagctgtaatggattaccgccctgtttttaaggacagcatcctgtctttccatctggggagtatacgtctttatttcctctccaatctgctccagatacatctggtcatcatcacagacagccacctgcagtctatccatgggatgaatcccccttattgttgtgtccatggggcaggacaatggttgcggctgatgcagcccgtcttaatcccatgttctccatatctccggctgatatccgattgtggcctttttgccgtttctgacaataggtgtcttgagcaccttctggttttccagaaccttttcatcccggtcctcagcagcaatgtacctgatgagtgccagcgcatccttatctttgcagtcagcattcagcatagcgtccagaccgcccacggcctgtttcacactggtgtactctcctttgctcatgcctttttcctttaaatctattagttggtatttgatgttccgctccttgaagtagcgttcggctttctttgtgccaaaacattttttggttccgaagatttgtatgttcattgggtcgtcctccgtttatgattaaaagtttcatagttccattatgtagcagcatctcggcggcctgaattaataaaatacttccggaaatcactgtaccttaaactgattcggagctttgccgtatttctttttaaattcctttgcaaagtaactcatatcgttgaatccacagctataggccacctcggatacggaagaattatgttctaatgctaatgccgctttctccagtctgtagttttttgtatactttatgggacttataccaagcgtcattctaaagcatcgcagcacttcacttgtgctgaccatggcataatcagctatctgcctgattgtgattttatctgcataatgaagatgtatatatgccagcatcattttcaaacgttcttcctgccttatagagttcttttcacgcgcatttacatgctttggtttgttcgcgatgatgatactaataagctttgacagttcatatcggacatctatctcatatccttttggttcatctgcgcactgctgccatgcttttaatatcaatgcattcatttccctatctgtttccgattccataccgatttttacataacacaaattctgtttatcggatataaatggccttgtgtagttctgccaaaaaacactgttctccctgcctcccgtgacagagggttcccagcaaatacattttaatctgcattctttatttgagtttgccgatatgccatggaggattccggaattgattataatactttcatgttctgacaacgttactgactcaacaccaaccatgacctttatatcgccagaaacaacagcaaatgcctcaatttcatcatgccaatgcaacggtaccggcattctgctcacattatccaaaaagcaggctattggaaataaagaagagcctgtttgcataatttcttttccatttttgtctaataccgcctctgtattacaggcagataatgccatagaatctccaccttttaactatattggtcattttgtcatattatttgactataacaaactaacaggattgtaaaaatgcttatataatcatagtacagcaattaatattatactgtcaaggagaactgtcgtgaaaaaacgctatcaaaaaacacttattgcatgttacctgggttttattactcaggccattgccgctaattttgctccgcttctttttattacctttcataagacctatcatatccctctgggaaaaattgcacttatctctactttcttttattttacacagttggtggtggatttggcatgcgccaagttcgtagacaaaataggatataggaccagcgtcgttttatcggagatagcttctgcagcgggcctcgcaggccttgcggtcctgccttctgtcctgtcaaatccattcattggcatcattctgtgtacgattgtttatgcgataggaagcggtcttattgaagttttagtcagtcccattgttgaagcttgtccttttgagaacaaagaaggaactatgagtttactgcactccttctattgttggggagccgtatgtgtgattttagtatcaaccattttctttgccgtatttggactggacaactggaaaattcttgcctgcatttgggctttagtaccgctttacaatatatacaattttgcaacctgcccaatcgaaacactggtagaagagggtaaaagcatgacaatgaaagaactgtttcaaaacaagcttttctggatactctcacttcttatggtctgtgccggcgcttcagagattgccatggcccagtgggcatcagccttcgcagaaagcgcactgggtgtttcaaaaagcatgggcgacatagccggcccggggtgcttcgcagttttaatgggtaccagcagggttttctatggaaaatacggagagaaaatagaattaaagaaatttatggttatatcaggagcactgtgtctattctgctatttattagccggattatcaaattcccctgctcttggcctggccggctgtgctatctgtggtttttccgtgggaatcatgtggccaggttccatcagcatttcatcaaagacaatgcctcttggaggcacagccctgtttgcccttcttgcattatccggtgatttaggcggttcattaggaccaggctttatcgggatgatttcacaaaatgctggtaataatttgaaaaccggcattttagccggagtctgttttcctattgtactgctcatatgcgtattctacctaatgaagcgtgagcgtaaataactgggctatttggggatgagctatttgggaatgagctatttggaactgggcgatttggaaccgggcaatttagaaccgggcaatatagaaccgggaggattctatgaaaatcgaatatgtgacactgtatgtgaacaatctggaattcattaaggaattttttatcaaatattttggcgccagtattgaaaaaactttaaatgttgcatttgatgcaaaagcatatattttatcattcgatgaaggctgtatgcttgaaataatgacccatccccataggaaggatacggaaaaattttttcgtagaactggctttaaccgtcttgtgataaatgtcggctcccaaaaaaagttatgggatatttcggaccaattacaggccgatggatatgacttaatcagctccccacatgatacatgcaacggatattatggttgctgtgtaattgattctgaaaataatttgatagaattggtaatataacccagatgaaaattcattaaataaaatatggtttaatcctgtaaaaacaatataaaaattcagattaatactcgtttctgcctgtataatttcttcttgcgtcataggtcgcgaaccattttcatcaggaaaagtaggttgtttacgcttatgaaaaagatttgaaagcaagtgccatatttaatattaaggcatagtctatcattttagaatacacgcattctttaaatagcatcaattctctaaatgagtcattattgggagcatattgaattattccctccaggaatccaagattttggtgggtatcatttaataaggcgattaattcatcatccattgtataaaaatcgcctgacatctacggggatggagtaaacgaataataggtaaatccagactgagcattttctttatgaccgatatattctcctgtgtatgggattattgtgcttacctctatatgtctatatgaagtatttaattaagtatatcatatattttgagatacagaaagaataatctcctattttaattcagaataatagataataatgaaatataaatactatattagtttccacgacctagccattcccacgcctcattgcttatcgaaatgggattcaatattttgatggtatcacagcgtttgggccacgataaagtggaaaccacctggcggacatatgcgcatctatatccggataaggaaaaaatgctggccacccaactggatactgccaaaatacacggaattgccggaaacctgtcagttgaggagcagctacttaaatttatgcagcagtttcaaaagtacgtcacggagcagcccgcacttattgatatcagccaggaagagatataccgatggaatccggaaaccaaagagaaggttttagtcacccaggaagaatttgagacaaaagctgagttagacgaaaatatagaggccgccttggctgttacagaaatcttccaggacggttacctggaaatctgtggcttggtgtattgtcttgccgttactgttcagaggtatcataaatcagtatcggcaaagtgacgaaatttaaaatttaagaaatagcgtattttgtggctatgtctagcttccagtctacaccatgggttctttctttacaagttagcctctgaacagtaacgcggcaccaggcagatgagaacaaatgtttaccttttgtttgacaatatctgccatgtttgatatacttagtatatcgaacaaatgtttggaggcaatgtgatgtcaagaaacagaacacatgcagttagatgtcctgattgtggttccatcataccaattaaaatatatgacagtattaccccatccgtgaatccggagctcaggcagcggattttagacggcaagtttgagatagtggtatgtcctgactgtagggctgtgttatacatacagtatgatattttatatcacgatactgccggaaagtttatggtttgcgtgggtaaggattattcggatatgattcagcagctggattgtccggctggatataagctgagatatgtggatgattacaggcagctggctgaaaagatacggatttttgaggcagggctgagtgatgaaatcatggagataacaaaagaggccatgcgccacatggcaaaaaagaatctggagctgtattatgcgggtaactggagaaagctgatgtattttacagttcccggccaagagaagcatatagcggtatcacaaggcctgtatacgctggccaggaaatattacgaccagattcccgcagaggaagaccgcggattccgcaggattaaccgtaagtacgcagaggcattaaagaagatacgggtatgatgatattcagagtgtccgtattagatggtaaattacagggaactgccagttgtgaaagactggcagttttttagtggtaatttgctagtggtaatttgcaggtgaaccagctcagtccatggtggagctaaggcggatgagaagaggcagtgttatctctccccagctgtaattaagcatgtagtcacccataaaagaagagacataggcgggagagccgtttatgaattcgaataaatcgcataagacggtatttttattcacatgtgcaccggcacgctgaaatgtgaccatattttcaattgcatatttttttaaggtggcgcgaagcgccatgattacacttcgatatctgcgtttaatcttttcatcatatggttcagattcccataaacaatcaatcgcctgttccatggtaacggttccgccctgtcggtcaatgagaagggctaagaattccttggattttttattgctgaaatacacaggagcatcgtccacatacacatcaaactggccgaatgtatggataaacacctttttttgcatggcagggagattctcaaagtaagaagacagaaaatccctgatggtaatacaggcgtcgttcagatcccggcccttttcccattttaagacaaggtaacggtatatattaggattttttatttcaatcagggaacagcattcgtcaaatataaattggtttgtaatggcagggatgatgctgactgcgcagttggcagatataagttttgaataggccatgttattatctgtttccataatgatttttggagtaaatcctgcgttgagacagtttttttcagtgatttttcttagaggatttgtccttttctggataatgaaggactcattggccaattcggacaaatccacggatttacgcacaccaaaggcatgttttttgttgacggcaagacataatggctctttcagcaaaaccatctcattgggctccgtcggagcggtttcctcggttacaatactgaagtcacattggttttcagtattgctctgggaaatactcaaatcaattgttttgtaagtttctttcagggaagtaaaaagcggggtcaacagtccgctgcaggcatgcaatgagatgctgacaggggcccgtgtgggctctgttctgatataagagaagaaatcctgtaaagaggcgtcaatgacatgagcgcagcgcagaaaatgttcgccgtggtcagtaagggaaaccatatcttgcgtatggcgcagaagtgtacactccaattctgtctgcaaagcatctaatgcactgcagatgacttccacgctgtcgcctgttaagacggaaacctcttttaaatccctgctttcagacagaagtgaaaagtagtgtactgtttttgtatccataattatccaatccccctttgactgattatttccggaacgtaataactatattatacaaacgatttcaggataacacaatgcggagggggcaaaggggagatgaatgaaacagctgctgaaatagctgatatttggcggaacaatagcggaatatagggagttggtttggtattttagtgatataagttaccggtaacccgtggtttgaaggaggaggagataggaatggaattcaatcggattaaagaggatgaattgacgagagaattaattcaatttcgaagacagagacacaagatgcccgaaaacgcgtggacggaatttctgaccacttcggaaatcatcaagaaactgcaggagtttggaattccttatattttcggaagggatgttcatgtccggggagagagatacggtgtgccgccggaagatgtactggaaaagtgtatgcagcgtgcagttggagagggggcggacccggagctggtagagaggatgagaggcggatatacaggggtggtcggagtgatagataccggaaaacctggtcctgtaacagccataaggtttgacatcgactgcaatgatgtagaggaatgtttaggcggggaacattttcctgccagagagcattttgcctcaatacatcctgatttaatgcatgcatgcggccatgatgtccatactgcaattggaatcggagccgcaaaggtactatctgtttataaagaccagctgtgcggtaaaatcaagctgattttccaggccgcagaggagggcgcacggggaggtgcgtcaatggcggcaagcggtatactggatgatgtggattatctctttggaggccatgttgctgatatgacaagccgtcttggccagtttgcagcttccaccaagaatggaagcattagctacaaagtggacctgatattcaaggggctgtctgcacatgctggtatggcacctgaaatgggacataatgcccttgctgccgctgccacggccacgctgaacatactgggaatatccagacacagcgcaggcaggaccagggtaaatgtgggcgcctgtatagcaggaccgggaagaaatgtcatcccggaccatgctctgctaaaggcagaggtcaggggccttacggacgatttgaatgaatatatgttcaaccggatggtgacaatagcagaggccgcggcccggatgtatgagtgtgattttacttataaaataatgggccactccatcgatgctgcatgtgatgaggaaatgacggctgtggcatatgaagcggcaaaagagacagccggagtcacgcagatggattcctttcatgatatgctgggaggcggggaagatgttacctttatgatgaaggaagtgcagaagcatggaggaaaggccacctttatgtggcttggctgtgattccacagcgccaaatcataatagtaatttcagtgtaaatgaagatgtgattccgttgactgtccgtttgttcagcactatggtttttaagctgaatggggtttaggtatgtaaaggagatgggtaaaaatgacgaaagataaggaaagtaaaaatagtgggtttatccggttcgctaaatatattgaaaaggttggcaataagcttccgcatccattttatttatttttagtcttaattgggattgtactgattgcttcgtttatatgcagtaaattgggggttacggtcagctataccaccgcatcacaaaagggtgaaatccaggaggtgacagctggggttgtcaacatgtgttccaaagcagagctgcaaaagtggctggccaattttattaaggcatttacagatagtcccaaccttacctcagtcctgataattactatgtgtgtggccatatgtgatgagagccagttctttaaggtcggactgcgcaagcttctttacaatgctcccaacagcatgataacatttgttctggccatggtaggtgtctgttccaatatctgttcagacggtggaacaatactggcggttatgctcggcgctattgtttttaaggccataggcagaaacccgtggattggaattattgtggcatatggttctgcgggcgccggttacatgggcaatttactgccgtccgttggggatgtggttgtatcttcaattaccaatggcgtttcagaaccattgggatataccatgaatccgatggtaaactatttctttcaggccgcagcctgtattgtgttggcattagtgactactataatcactgaaaaggttctcgttcccctgtatggggacacagacagaaaagcgggtgcatcaagtgaccgttctttgctggaattgtcatctgaagaaaacaggggaatgaaatttaccgccattggaacgatggtttttattgttatgatgcttgtattctgtatgccgtcaaacggtttcctgcgctcagatgaaggaaatctgctgcccagttctccgctgatgtccggcctggttcctatcatctccatcttttttgttattctgggggtatcgtacggagtgggttcaggcgtcattaaacataaaaatgatattcctaaaatgatggccaatggtgtgaagagcgtttcatcgctggttctgattctgtttgttgtatctgaaatgctttacgtattcaataaaagtaatctggcaaccataatttcagtaaacggggaacggcttttagagtccattcattttaccggtttgccgctgatgattgcttttatagtggtaatagctgtaacaaacctgtttatgtacagcgcatccgccaagtggatgatactggctcccatattcgtaccaatgtttttaaaccttggcataaacccggtcacaacccaatgcctgtacagaataggagactcatgcaccaataatctgactcctttaaatgcagcgattgtgttcgcaatttcaatgatgaatcaataccgtataccggagataaataaggaagaggctggcatgggaacattattatcgggccaggtggtcttctccatcgtgtatctgggcgtactgatagcaatgtttcttgtgttttatttttgcggtatccccttaggtcttggaggttgagacaaaataacccgggaatatgggtgaaacggcctgcttcatccgcccatccgtctattgccagaatcctggttttatgataaaatccatatgggataaaatcaagatatgcgctgcggcaggcagtgcggaatggagaagacgaatgaaagcatttgattgcgttaacaagcaggaagttgaagtgacgaaggaaggtttgattgacttcatgaaaaaggaccgccagattgatatgaagtttgctgagaagagaacggatgacatgggatatctgacctgggatgcggagaactggacctgtgtggatggacagaacaagtttatgcgctgttattcactggaaggccgtgtgctgagagattccaccacccataatatttatgatatggaaaatgactttttcccggaacaggccatggagattcagattaactaatcaggaaggtgtgtttatctatttacttaatcattcattgacaaaagacggcggaagccgtcttttgttgttgtgctttgcttatttgtgtgaaaaagaaaagcagttagttatccttatacccctgaagagaggagtagccagcgggcggttcccgctggctgagtattatgaaaaaaagttattagcattgaccttttacaatagatagtatattcagaaaatgtgagcagtctgttgcaaaagtgtgaacggtttgtaataagtttatgaatgaaataagaatgtacaaattgcacaaaaaacaggaagatttcttgactaaaaaagccaatagactaaaaaagatttagagtatataattaattttgtattaaatattggtgctattcactatgtatatcctgagaattggctcagagtatctaccaactaccgtaaagagttgactacatggctttttgtagttggctctttttttgcagttaggtatttgcccatgggagggggcgggaatgatagggctgcaggattccaactacaatggatagcggaaagagaaatctgtacatatcacgcagattaaaacatgacatggaggacatagtattgaaacaaaaaacaggatgcgtagaccgcttttttcaggtctcccaaaaccattcaaacgtaaggacggaagtgcttgcaggaatcaccacatttatcaccattgcctatattcttattttgaatccacagattttatcggacccatatgtcatcatgggggatgctgtcatggcaggaaagattgcaaacggcgtattcatcggcacatgtatcggagcgttcattggtaccatcctttgtgccctgtatgccaaggttccctttgctcaggctccgggaatgggcctgaatgcgttttttgcgtacacagttgtactgggaatgggctacacctatggccaggcactggtcgttgtgtttatctcaggcattttctttatagtgataacagccatcggcctgcgggaagcaatcatacgttccataccagatgcagttaagacagccatcacccccggcatcggcctgttcatcaccatcatcggactgaaaaatgcaggaattgtcatctccaatccagccacccttgtaagtctggtggatttttcacagtggaagatagatggggcggacctggccctcatgagcagcgcattggttgcgctggccggactggtcatcatgggagtgcttcatgcgagaaaaatcaagggctctatcctgttgggcattgtggctgcaacgctcttaggaataccgcttggtgtaacccacctctcaaacctggatatgaatatcggattaaaattcagggattttgcagaggtgtcattcatgaaaatggatttcgccggattattttcaggtccaaacatggtggaaaccatatttacggtaaccatgctggtaatcagcttttcgctggttaacatgtttgattccatcggcacccttctgggcgcagccaagcagtccggcatgattgatgaaaatggcgaggttatccggatgaagcaggctctgatgtcggatgccatctctacggccgccggcgcaatggtaggcacatccacagtaaccaccgtggtggaatccagtgcaggaatcgcagcaggaggccgtacaggacttaccagcctggtgacagcccttatgtttctgggagccattctctttgtgcccattgtcagcatagttcccgcagcagccactgcaccggcgctgattttcgtgggcatcctgatgctgggaaatatcagggatgtggactttggtgaaatgaccaatgcgcttcccgctttctgcaccattgtttttatgccctttacatattccattgctaacggcgttgcatttggattaatcacatactgcctgatgaagcttaccaccggcaggagacaggatgtgaaggttcttacactggcgatttctgttgtattcgttgtaaggtatgcatttatgacattgggttagaaggaaaggaactgttttattcgtaagggcggactttagacaggaaacaaaacagggtaccgcaaaatacacaggaagctggcagatactatgctgacagcttcctgttgtttttttgctgaactatccctgttccggacagaggaaagggttgggggaacaagaaaaaataagccgcactataaaatcagggccgggtatggtaaaatacagttattcagatgctgcctgttaaattatccctgaaaaagggaggagccagtgagattaaatcccactggccgagtattatgaaaaaaagtcttataagcattagctgtttacaatataaagtatatccgttaattatgagcagtctgttgcgtaaatgtgaacagtttgtaagtagtttgtgacgaaaatcatgcaattttcttacgggaaaatcaaggaaaacaggaggaacagggatggggggcagaataaaaaaatttttaggaatcacccgggatattccggattttgaccaggtaatccaggccttgcatagtgatgtggccagacggaatatttattttcacttattcatcattgcttttgagtgtattatggcggtgtccatatccatgaggccgggcggtccctttgcaaagccgcgccgtgtggcgtattttttcctgtatctgaccctcatactggcgacagcaggcgtcatgtgggcggaggcccggatagacagcaggaaggaaaaggatgtccgcctgtatttccgaatcgaggcagcctatcttgtgtttttcagcttctggggcgtggcagtcactctcaatgaccagctggggggcaacggactcactgtttacaattatgtcattttgattttggctatcatgtccatgatgaagccatggcaggcagggcttttgtttctggcggactttttgttattcaatggtctactgccgtatttcccggatccggccggattggataacagttttaacaatatgatgaacagcctgttttcatccctggcagcagcagccattgcagcaagtctgtacaactctaagatacaggaaaagagaaatgaaattatcatcaaacagcagttaaggcagattgaatcagccaaccgtatgctgagccgggaggcgctttcagacgcccttaccagcctgcagaacaggaccagctttaaaaaggcgcttcatgcctttgaaagcgggaatacggattgcagaaccctggcctgtatttatatagatgcaaacggactgcatgaaatcaacaatcatcttggacaccagacgggagacgggatgcttaaaaccgtggcagacattctgctgaaaaactttgactttgaagagattttccggattggcggtgatgagtttattattctgagcaggaatgtgggccggcaggagctgatgcagaagataaaacaggtctgcggacagacagaggaggccggtttctccctttccatcggactggagtggcgggatacggaccttgacatagggcaggtgattcagagggctgaggcagccatgcaggagtataaaaaggggtactattcctccaagggcggtgaacggcagaaacgcgcgctgaacaagcatatggaacaaatcatttcagagaagaaggatgcggaccgtttcctgagcattttggcgccggtattcaccggggtatattttgtgaatctggagacagatacgctgcggcagcttttcacaccttcctatttccaggagatgctggaaaaaagcggaaacaggttcagtaaggctctgatgctgtacgcaaaggagatggtggagcctcagtatctgacgctgtttgagcgctgctgcgattatgcctgtctggaagaacagctggagggcgatgaaattcccggcattatctaccggaaaaaggatggaagccagctcaggctgagaattcttaatttttatcattacggaggcgtcagcaaagaaaccctgtggattttttccgacatagaggtcaattatattgagtcctgacagaggccggcggaaaatggtgtaaaaaagaggggcgctgccatgagtaattggatttcatggcagcgcccctttatcatattgaagctatgattagatggaggttgactggagccagaagttagaaccggagccagccagtgtgaccgtataggtctgattctgcaggaacgtcatccaggtatctaccagaggtgtgctcaggtcgttgccgcggtaaaccgtgatgcggtagcgcccgggaatgacattgtagaaacgggtgaaattcaaaaagttcaggttagagacaaccgggcggttgttcacgtaaatctggattggtccccggaccgctgcattgtagaatctgacacgcgcaggtgtaatgggaaggacgaaccccggcaggattgtgccccaattccaggaccagtcaggtcttggaggaaatggtcttgggggaaatggtcttgggggaaccggccttggaggaatcggtcttggcggcataggcctcggcggtatgggccttggaggtcttgggggtgttggtcttggaggcattggtcccggaggattgggtcttggaggcattggtcccggaggattgggccttggaggcattggtcccgggggattgggccttggaggcattgggcccgggggattgggccttggaggcattgggcctggaggagtgggcctgggaggaaccggtctgtttggaatggggcgggcagaacgttcctgtatgtcaaggtcctcctcctggcccgtccaggcgtcctggtcttccgggagcggaagaatggggtcatttaggtcattttcctgggaattcagccattcatcggattcgtatgattcgtaatcatagtcaggatagataagggacgaatccatatcatcctctgccatggacggatagtagttatcgttatacataaggtaacctttcataatatgctttgtcatatcttatgcgtggaaaaaaaaattgtgcggaggggcaggcttgggggaacagccgcaaaatgcacaaaataaggattttcgatgataaaactttgggcagacttttttgatagtgtatgctattataataaacgtaacccccccaatacattatatagtttttgctacaccccataagaaacgaaataccttctcctaaaatgaccagttccccgactggtcattttattttgattgacttgcggggaaatctggtctactattaaatggaatttcagataggagagactggctcatgaataagaaagaaacaaatgaaatcaagaaattgtttaccccggcaggctgtgccatcacccgaatctgcggctgctacgtggacgcggagaagaataagaagacagagcttaaggaggctttcctctccctgcaggaggaagaagcatttaaatattttaccatattcaggaatgccgtttcagggaccattggaaagaacctgattaatatggagtttccgttacatacagaggcagagggaggcacccagcattttcttttaaggctcagggacagccagctgaaggatgacgctgttctggaggagttctatgacaaggttattgccaattatgattatggcgagaactattacatcattctcatccactgtgcctatgatatacctgccaaggcaacagacggcacggagatgttcgacgcgtcggattatgtctatgaattcatacaatgcaccatatgccctgttaagctttcaaaggcaggattgtgttataatacccttacaaacaccattgagaaccgtgagcgggactggctggtggagccgcctgtccaggggttcctgttccctgcctttaacgacaggaacacggacatccacagcctgctgtactatgccaagaatccggaggagctgccggaaacattgattgacgagcttctgggctgcgtgatacccatgtcggccaagagccagaaggagactttccaggccattgtggaggagacgctgggagataactgcgactttgagacagtaaagaacatccatgaaaacctgagtgaactggtggaggagacaaaggatgagcctgtacccctgactctggacaagtatcaggtaaagaagctgctggagacaaacggcgccccgcctgaaaagctggaggaatttgaacagagatatgcagaggtggaggatgggcccggcaccagctttgtggccgccaatgtggtaaacaccagaagctttgaaatcaaaaccccggatgtgagcattaaggtgtctccggacaagacctatctggtggagaaccggatgatagagggacggccctgcattgtcattgccatcaatgagcatgtggaaatcaacggaatcacggtacgcccggttgctgcccaaaggcaggcagagggggagggtacgtctggacaggctgagtaaaaatccatagggaaaatgataatataagaagccggtccttaccgcgtcgggtatggaccggcttttccggttacgaatatgccgagaagtgtcccggcagtacttagatgcgctccgcgttatcacgcatgtatttgaattcagccacggagcggtcaaaggtctggatgtgataatagagccagtccctgaccttttcagagactttttccacaaaggcgtccgtggggccctcctcctcggtcagcatttcatggagctcctggaccgtccgcctcagttcctcatgtttttccttgtgttccttgatacctggataatttatggattcctgaagggcctcttcttcattgaaatggtactcggtgtagtcggccaggaaattaagcattctggctgcgccgctctgattggaacgctcctcacagctctttaataaatcattgattttacaaatcagttccttgtgctgggtatcaatcatctcattgcctgttaccaggtcatctgtaaattctgcgtacatgttacaatacctcctgaatgtttgatatatataatttatcacagataatgggaaaatactatgacttttgcaacaataaagacaaattgtcagatgaatgggaatcactgccagggttggaatatcatatcttcgacactccgaatacactggaaataggggtgggtatacatgtaagaagttgtctggacaaaaaagtcaatagttgatataatgaccatgtacgcttggcaatcataagataatgggaggatgaagatacagatgagtcggacaattagtgcaggttatgtatatcgtcaatattctaccgaaggtgtttatattgcagattataaaagctccagggctgcccatgaggcgactggggtctccatcggctccattgcacgggctgcccatggtgaacgcaggaccggaggcggttacgtctggaggaaggtgctggcggattcaccgaaggatagtatcgaaatagatttaatcagtaaaataggaaaccatgataaacgacctctggtccagaagaatctggacggagaaatcgttggggaattcctctccatcgcccatgccagccggacccttaaaatcagccgcaggagcctttcctgtgcgctcagcggggctcagaagacagccgggggctacatatgggaagagaagatggaggatgatatccaggttcaggggcagtaggcttcaaactgctgtttgatagaggaaattaaccgttacaggataaaaaagcagtccgggtatttgggctgttttttgttttttgaggaagtatcagggtatgttcggaaagtctgtaaataaaagaaaaaaacgcagaaatttgattatatttgcaagatatttctggaaatttgcatgagtttatagtacaatattgattaagaggagttgcatccctataacagaggaggacgctaaatgaaacgtgatgatttggtttggagtgaccgcaaaaggaactggctgggactgccctggacattcactgtatatggcctgacagaagaccggctgttcattaagacaggggtccttaacatacatgaggatgaggtgcgcctttaccgtatcctggatttgtccctgaggaggagcctgtggcagagaatcatggggctggggaccatccatgtggacagcagcgataagaccatgaaggcctttgatatacagaacatacggcgctgtgaggatgtgaaggagcagctgtcgcagtttgtggagcaggagcgggataataaaagggtatcatccagggaattcatgggcggatacggggaagatgaggatgaggcctttgatgagccggacagccattattaaataataagaaacagccatgttattttatttaagaaaggggactttgtatggggaaaaaacggaatatcatagtgggacagtcgggaggacctacctcggtcattaattccagcctggcaggggtctataagacagcaaaggaaaggggattccacaaagtatacggcatgctccacggcattgagggactgctggatgagatgtatgtggatttgtccacacagattcattctgatatggacattgagctcttaaagaggactccctcggcatttctgggctcctgccggtataagctgccggatatccatgagaacccggctttttatgagaagatattcaacatactggataagctggacattgaggtctttatctatatcggcggcaatgattccatggataccattaagaagctgtccgattacgccattgtcaagggccatggccagaagttcctgggcgttcccaagaccattgacaatgacctggctcttacggaccacacccctggtttcggcagcgcagccaaatacatagccacctccaccaaggaagtgattcgggatgccatgggcctgtcctaccgccgtaagaccatcaccatcatggaatgtatgggaagaaatgcaggctggcttacaggctccacagctctggccaagacagaggactgctgcggaccggatttgatttatctgccggagataccctttgacattgataagttcctaaagaagtgcagggacctgattcagaagaagccgtccattgtcattgcagtgtccgagggaatcagggtgccggatgggcgctatgtatgccagatggcgggaggaagtgattacgtggacgcctttggccataagcagctggccggtacagcggattatctggccggtttcctggccggtgagctgggatgcaaaaccaggtccgtggagctgtccaccctgcagaggagcgcttcccatgtggcttcaagggtggatatcaatgaggcattcatggtaggcggagccgctgtcaaggcagcggatgaaggtgacacgggcaagatggttgtcattgaccgggtttccgacgacccttatatgagcgcggcaggcatatatgacgtacacaagattgccaataatgagaagacggtgcccaggagctgggtcaataaggacggcagctatgtaacccaggaatttgtgaattatgtggagcctttaatccagggagactaccagccattcatggtaaacggccttccccagcaccttgttcttaagcggtaaggaccagagggggcctataatttctatgaaaacattaaaaattgcataataaatgccttctgcaacggaaaagaatcagggcggtttcccagttttttgggaaccgccctgaagttttgataaaggaatggggaggaaaaggtaaaaaatggcatttttgcacaatgaaatcttgtatttatttagggacaaggcatgaaaggaaatttgacaattgaatataatagtgatatatatatttcaaccactttcaattgttatctgttggacggtcccttcctgtaaccgacgggacagggatgtcacaaaaaaggagttttgactatgaaagaaaagaaaatcatgttacccacaatggctgaggcaaagagatttgttgatgaggctacaaagtgtgactttgatattgatgtattctataaccgagtaacgattgatgcaaagtccatccttggtgtgctgagcctggacctgacccgggtcctgaccgttcagtttaatggtgagaaccagggatttgaggaatatctggataccatttcaccggaaaccaatgcaaacgctgcctgatgagggcgcggttagaggaggattgcgaacacttgtttgcaatcctcctctttttatgttatgataccctatattatgtatggagtggacaggggaggaagaaggagttggagaatcattcgcagccccagatacgcatttcggtgcggaacctggtggagtttgtaatgagaagcggtgacctggacaaccggagaacggcgggggccaggaaggaggccatgcaggccggaagcaggctgcaccggaagattcaaaagcgtatgggagccgcctaccgttccgaggtaatgctgcggcatcaggtccgggaggacatgtttgatatactggtggagggaagggcggatggaatcatcaccgagccggccggtgtgaccattgatgagattaagtgcatttacatggacgtatccaggctggaagagcctgacccggtccacctggcccaggccctttgttacggatggttttacagcgtacagaatgagctggaatccattggaatccagattacctactgtaatatagaaacagaggaaatccgccgttttaaggaggccaggagctttggggagctgaaggcgtggtttgaggggctggttcatgagtatgtcaagtgggccagatatctgtatcaccacggtatacgccgccaggaatgcctaaaggagctgccctttccatatccctacagggagggtcagaaggaactggccgggaacgtgtaccgctctattgccagaaagcgcaacctgttcatccaggcgcccacaggggtgggaaagaccctttccaccatttatcccagcctgaaggccatgggggaaggccatggtgagaagctgttttacctgactgccaagaccattacaaggagcgtggccgaggaagcgttttccatcttaaggcgggaggggcaactttattttaatacagtcaccatcactgccaaggaaaagctgtgcgtcatggagaagccggactgcaatccccaggcatgtccatgggcaaagggccactacgaccgggtcaatgacgctgtctacgaaatcatccaggaggaggacggcattaccagggacaaggtgctggaatacgcagagcggtatcagatatgtccctttgaattctgtctggatatcagcaactgggtggacggcattatatgcgattacaattatgtctttgaccctaatgtgagactgagacggtattttgaccagggggagccgggccagggctacctgtttctggtggatgaggcccacaacctggtgcccagggccagggagatgtacagcgccggccttgtaaaggaggacgtgcttctggcaaaacgcatattaaagacacatcccggagcaggcaaggtcattgcccagctggataagtgcaaccagaagtttctggaattaaagcgttcctacggaggggatgagggcgggcgcaggaccgtgctgggaagcacctatgagcttttgccggatgtgaacattctggcactgaacctgatgaccatgtttggggagctggaaaccttcatgaatgagaacatggagtttccggacagggacctggtgctggaattctactttgcggtccgggattttctctatgtgtatgacaggctggatgacaattacagaatatatgaccagattcttgcggacggcagcttcatggtaaagcttttatgcatcaatccgtcggtgaacctgaaggagtgcctggacaagggggccagcaccctgttcttctcagccaccctcctgcccatccagtactataaggagcttttaagcggcagccaggaggagtacgcggtctatgcaaagtccccctttccccaggagaaccgcatggtcctggcagccagcgatgtcagcagccgctacagccggagagggccttttgagtatgagaagattgcggactatatatgccggattgtggagggaaaaaagggtaattatatggtgttctgtccctcctaccagtatctccatgccatagaggatattctggcagccagggaggcggcaggaagcctttcttttatatggaacgcccagaccagccatatggcagaggaggacagagaggcgttcctgcaaagctttgaggaggacagggattgttccatggcagcgctgtgcgtcatgggagggattttctcagagggaattgatttaaaagaagagcgccttatcggcgctgtcatcattggaaccggactgccccaggtaaacacggaacaggagattctgaaggaatattttgatgaacacggggagcatggttttgactatgcctaccagtatccgggtatgaacaaggtgatgcaggcagcaggccgggtcatcaggaccatccatgaccggggaatcatcgctctgctggacgaccggttccttcgcccggaatacgtggcgctgttcccaagggaatggggtacctacaccgtggtgaaccggtataatgtggaccaggcggtgagggcgttctgggacgggttccctataacatgtccatgaactgtctggctgcctgggatacgggaaggctttcattgaaggccaccatcatttggcgggaaggaagctgttcctttaaatccagaatgaacaggtcctcgtcatgtttgggaatacagaaatcagggacaaaggcaattcccagaccgatacgggccaggtcaatgagcaggtcgttgctggacagttcgatttccggcaccaggtccagctggcttttctgaaagacctgatgaaggaattcactggtggtgcttttgcggtccagcatcatgatgggatagcggagcagctcctccagggacagcgtggttccctctaaggagaaggcgctgcggctggcaacaaacacatcgtgaaattcattgataacccgggtgttcatactgccggccagggcggaattgggatagtttgccacgataaagtcagcctgtccgttttccaggaattttgcgcactcaatggaagtctggttgataaccttgatatggatgttggggaattccttgtggaaacggttcagataggggaccaggtaatagcggcagatggtgtcgctggctccgatacgcagctgccccccgttaagggtatgggcttccagcagctggttttccccctttttaataagattcatggctggttcaatatgctttaaaagaatctccccttccggggtgagctgtactttcttggtgctccggatgaacaaaggctggttaagctttttctccaggactttaatggactggcttacagcggactgggaaatgaaaagctgcttggaagcctcggaaaagctcagcgttaccgccacatggtaaaatactttataaagttcatagttaatatccattattaagtcctccttataaactaagcatatcttatcacggttagcggggctttgtaaagagggaaacttgacttatggtttggcatggattatcctattaaggattatggatggaacttgaaattaaggagaattgaaaggacagaagtatgatggaacaggatttttttgatatgtatctggaagagatgggggacattacacctttggacagcaatgaaaagggttccgttcttgagggaacagccaggggcgatgcaggggcgcgcagccgcctggtggagggctgcctgagggaagtactggagatggtccgggaatatggagacagcgagcttcccttatctgatttggtacaggaggccaatacggctctgatgctggcagccattgagtatgatggcagcgaaccgtgggatgaacttatgacccgccgcgtgaaggaaagcgtggagctggccctggaggagcagaggacggagaagcagattgaggaaaccatggcggccagggtcaatgtgctccagacagtatcccaggtattggcaaaggagctgggcagggaggcaaccctggaggagctttcctccaaaatgaagatgacggaggatgaggtcaaggacatcatgaagctggccctggatgctctgacagtcaatggagaaggccaggccgccgcttcgcaggatgaggaagatacgtccaatccggtgaggaacggctggaatctggaggagggcctgtagatgaaactctatatcatacgccatggccagaccgactggaatgtgcagggaaggatacagggcaggcaggatatcccgttaaatgcagcaggccgcagccaggccgggatgctggctttgggaatgaaggagcgtccggtttcggccgtttactccagtccccagcttcgggccatggagacagccagggcccttgcagaggaccagggggtggaggtcatatctgtgcctgagctggtggagattggatacggcaactgggaggggaggactgcccaggatatactgaccagggagcgaaagctctacgaagaatggtggcagcatccggccacagtggctcctcccggaggcgagaccctgaaccaggtggatgccaggtgcaaaaaggcctgggaccggataaagagggagatgaggggggatacggcagtggtggcccacggcggtacgctggctcatttcattgtccatcttcttgagggccggcaggatgcagaggaaatcgtggtggggaatgccagcattaccaccatggagtatgacccggccgccggacagtgcagcctgctggagttaaatgactgcagccatttaatgcaaaaataatgttaaaatattgacataatttttaggggaacaattcccaaaacacttgcgttccaggggggaatatattagaataaaggtagttttgtaagcgcttacaatttatgaatggaggtatttctatgacagaggtaaaaggtaatgtaatcgtagggcagtccggaggtccaaccgcagtgattaattccagcctggcaggcgtgtttaagacagccaaggacaggggcgccaggaaggtgtacggcatgctccacggcatacaggggcttctgcaggagcggtatgtggatttggaggagcacatcaagtcggatttggatattgagcttttgaaaagaacgccctccgcttatctgggttcctgccgtttcaagctgccggagatttgtgatgaccgggagatatacgataagatattttccattctggacaagctggagatagagtactttttctatatcggcggcaatgactccatggacaccattaagaagctttccgactattccctgctcaacggcagcagaatccgctttatgggcgttccaaagaccattgacaatgacctggcggccacagaccatacccccggatatggcagcgcagccaagtatatcggcgccattacaaaggaggtcatccgtgacggattggtatatgaccagcagaatgtgaccatcctggaaatcatgggccggaacgcaggctggctgacaggagcagctgctctcgcaaagggagaggactgcgaggggccggatatgctgttccttccggaggtgacctttgacgtggatgctttcatgaaaaaggtggaggagcttcataagaagaaggcatcggtggtagtggctgtgtccgagggcgtgaagctggcggatggccgctatgtgtgcgagctgacagacggcattgagttcgtggacgcctttggacataagcagcttacaggaacagccagatacctggcagaaaaaatcaaccgggaagtgggatgcaagacaagggccattgaattcaattcccttcagcgctgcgcgtcccatatcgtatcaagagtggatattacggaagccttccaggtgggcggcgctgccgtgaaggaggcctttgagggtgagacaggcaaaatgattatcctgaagagggtgtccgatgacccctatgtgtgcgtgacggatatttacgatgtacataaggtggcaaatgtggagaagaaggttccaagggaatggattaatgaggcaggggattatgtgacggaggaatttgtgaactatatccggcctctgattcaggcggagctgacgcctattatgacggacggactgcccaggcatttgtattatacggatgtggagagaaagtagggatttagaagcgcgcggtattggggctcaccttgcacaggtcctctgcatcgcacagccggaaaccccagtcctttgctgtttgcgggactggggtttccggctgcagggagcgcagggataaatcgtttattctatttcactaattattgtaacaaaaatagtaagcattctaattaattgaattttactgaaattgctgggaatataacccatattggtcctgggctggcagccgggctgaaaacagccggggtactggcgatggcatcatcagtggtacagctttttatgctcatataccggctcggaagtgagctggacgcccagtttgccgaataccttgatgtccacgtcggacagcatcacggaggtgtggacctggcagccgcggagcttggggagctgggccagggccttttttgcggtttggtcagtggcggcgctcatgctcagggcgataaggacttcgtcggtgtggagacgggggttcttgctgcccatgtattttgtctttaaggtctggatgggctcaatggccgatggcgcaatcagatggatattgtgcgggatgtctcccaggaccttgatggcgtttagcaggagggcggcagaggctcctaacaggctgctggtcttgcctgtgacaatggtgccgtcgtttaattccatggcagcggcaggaccgccggataccttggcacgctccaggcagggcgcaatgacagcgcgcatggtggagtcgatttttgccttgttcatcagaagattgattttgtatacttcatcggaagtcccttcctccttggccagacggttcagggcatggtagtagcggcggatgatttcctgcttcgatgcttcgcagcaggcttcgtcgtccatgatgcagaggccggccatgtttacgcccatgtcagtgggggatttgtaggggctttcgccgtatatgccttcaaaaatggcgttcagtacagggaaaatgtccacatcccggttgtagttgaccgtggttacgccgtaggcttccaggtggtacgggtctatcatattcacatcgtttaagtcggcggtggctgcctcgtaggccaggttcaccggatgctttaaaggaaggttccagatagggaaggtttcgaatttggcatagccggccttgatgccgcgcttgttctcatggtacagctgggagagacaggtggccatcttgccgctgcccggacctggagccgtgatgattaccagaggacgggtggtttcaatgtaatcgtttttgccgtagccttcatcgctgacaatgaggggcacgttgctggggtagccttcgatacagtaatggcggtatactttgatatcacggtgctccagcttggctttgaactggtcggcgccgttctggccgctgtactgggtgatgacaacgcttcccacatagagacccttgtccctgaattcctgaatcagacggaggacatcctcgtcgtaagtgatgcccaggtcgtggcggaccttgttcttttcaatgtcggctgcattgatggcaatgagaatttcggcctggtcagccatttgaaggagcatacgaagcttgctgtccggttcaaagccgggcaggaccctggaggcatggtagtcgtcaaaaagctttcctccgaattccagatacagcttgtctccgaattctccaatacgctgtttgatgtgttctgactgcatggttagatacttttcattatcaaatccgattttcatttcttctgtaatctcccggttttttataatcacatacttttctagtatagcacaatttaattctgcgcgccataatagtttaatcggattgaaaaggcgggatttgctgcaatctgtatccgcagccgtaaaatcatacataccggttgttttataagaaaagcacttaaaaaagattaaatatattaattttactaatccatataatctgtgataatataaggcaagatgaaaaggcgtttgtcctttttgcgttgccgcataaatatgccaatacaacaggctatgaaaaaagcaggaggttgctaaatgagcgtaagacgaatatttgtggaaaagaagccagcttatgcagtgaaggcaggggagcttcgtgaagaactggaacattatctgggtatcagcaatgtggagaatgtgcgggttttaatccgctatgatattgagaatctgtcggaggaaacctataaaaaggcgctggtgaccattttctcagagccgccggtggaccaggtgtatgaggaagaatttccgaagaacccggaagacctggtgttttccgtggaatatctgccgggacagtttgaccagagagctgattcagcggagcagtgcgtaaagcttctgaaggaggatgaggagccggtcatccggtccgccaccacctatgtgattacggcgcctctgacagcggagcaggaggaagcaatcaaaagcttctgcatcaacccggtggacagccgccaggcagaggaggagaagccgcagactctggtgacggaatttgaggtccctgaggacatacggtattttgacggatttatggattcttcagaggaggaactgagggctctttacggcaccctgaatctggccatgaccttcaaggactttctccacatacagaactattataaaaaggaagagcacagggacccgtctgtgacggaaatccgcgtgctggatacatattggtcagaccactgccgccataccaccttttccacagagcttaagaatgtaagctttacggacggcgattacagggaacccatggaggaaacctataagcagtatctggctgaccgtgaagtgatttataagggaagggacgacaagtatgtgtgcctgatggacctggctctcatggccatgaaaaagctgcggagcgagggaaaactggaggacatggaggtttccgatgaaatcaatgcctgcagtatagtggtgccggtggagattgacggggtgacggaagagtggctggtgaatttcaaaaatgagacacacaaccatcccacggagattgagcctttcggcggcgctgccacctgtctgggcggagccatccgcgacccgctgtcagggcgtacctatgtgtaccaggccatgcgcgtcaccggcgcggctgacccgaccaggccgctgggggagacccttaagggcaagctgccccagagaaagattgttaacagcgcagcccagggatattcttcctacggcaaccagattggtctttcaaccggttatgtgaaggaaatctatcatccgggttatgttgcaaagagaatggaaatcggcgctgtcatgggcgctgctcccaggaaggatgtcatccgtgagacttccgacccgggggatatcatcattctgttaggcggacgtacgggccgcgacggaatcggcggtgctacgggttcgtccaaggtccacaccacagcctccattgaggtgtgcggcgctgaggtgcagaagggaaatgctcccacagagcgcaagattcagaggatgttccgcaggcccgaggtcagcagcatcatcaaaaaatgcaatgatttcggtgctggcggcgtatcggtagccattggagagctggccccgggccttaatattgatttggacaaggttccaaaaaagtacgcaggactggacggcactgagattgccatttccgagtcccaggagcgtatggcagtggtggtggaccctaaggatgtggaccggttccttgcgtacgctgcagaggagaacctggaggcagtgaccgtggcagtggtgacagaggagccaaggcttaagatggactggcgcggcaagaccattgtgaaccttagcagggctttccttgataccaacggggcgcaccaggaggcagacgtgactctggaggttccaaaccgccagggaaacctgtttgaaaagacagaggtggctgacgttaaagggaaatggcttgacatgctttccgacctgaacgtgtgctcgcagaaggggctggtggagcgctttgacggttccattggcgctggttccgtgttcatgccttacggcggaaaataccagctgaccgagactcaggccatggtggcaaagcttcctgtactgaagggccgtacagacactgttaccatgatgagctatggctttgaccctgagctttccagctggagcccataccatggcgctgtgtatgcagtggtttcctctgttgcaaagattgtggcagccggcggcgattacagcaggattcgtttcaccttccaggagtatttccgcagaatgaatgagaatccgtccagatggagccagccattctccgcgcttctgggcgcctacagcgcgcagctgggctttggcctgccttccatcggaggaaaggacagcatgtccgggacctttgacacggaggatggtgaaatcaatgttccgccaaccctggtttcctttgcagtggatgtgaacagccacaagaatgtgattacccctgagttcaagcgtccgggcagcaggattgttgtgttcaggattgcaaagaaccagtatgacctgccggactacagccaggtcatggacggatatggaaaaatatttgaagatataaaagcaggacgcattatttccgcctacgcggtagagggcaagggacttgcagaggcagtgagcaagatggcattcggcaacaagctgggtgtgaagattgagcacaatgtggacccgagggatttctttgccgcggcatggggcgatattgtgtgcgaggtgcctgacggaatggtgggacagctgtccataccctatactgttatcggcgaggtgacggacagaagcgcatttgagtacggaaatgtgaccattgctatggatgaggcattggatgcatggatgactcccctggaggacgtgttcccgactgccaccggcaaggaggcaaagggggatgaagctgcgctggaagaaaagctgtatcacagtggcgcagtgtatgtgtgcgaccataaaatcgggcagcccactgtatttattccggtgtttccgggaaccaactgcgagtatgacagcgccagagcctttgaacgggcgggcgcaaaggtggttaccagggtgctgcgaaacatgagcgccggggatatccgccagtccgtggacgaataccggagagagattgcaaaggcccagattgtcatgttcccgggcggtttctcagcaggcgatgagccggaaggctccgccaagttctttgccactgtgttccgcaatgcagtgatgaaggaggagattgagaagctgttaggcgagcgggacggactgatgcttggcatctgcaacggcttccaggccctgattaagctgggacttctgctggaaggggaaatcaaggagcagggaccggattcacctacccttgccatgaataccattggccgtcacgtttccaagatggtgtataccaaggtggtatcggataaatccccatggctggcaggcgctgtcccgggcagcgtatactgcaatccggcatcccatggcgagggccgctttgtggccaatgaatcatggctccacagactctttgccaatggccaggtggcaacccagtatgtggatgaccagggcagatgcaccatggacgagtactggaatccaaacggctcctatatggctatcgagggcatcaccagcccggacggacggattctgggcaagatggcacactctgagcgccggggagaggcagttgccatgaatatttacggggaacaggatatgaagatatttgagtccggcgtgaagtattttgagctgtaggaaaaccagctgttaccattggaaaccaattgccggttcagccggaaactgaatcatgtaaatgcaaaagcagagcatatcacaggccgttacctcctgtggctgctctgctttttctgtccgcattccattccatacaccttaaagcgttttctggtaacccagcctcaaatcgcctgcttcgctgccttctgtgagaaccagggtgccgcagcagatgtatccgcttttgtccagggcgcgctgcatggacgtattgtccggatgggtgtcaatgcggatattgcggattcctgtttccagagcgtactgttctgattctgaaaacagccgggcggccagaccacggcctttcatggtttcctccacacagacccggtgaaaggcagtgtaaggctcctggttcagccaggcgccgtctatggaggcatagctggcttcgggaccagggacaatggttatcattccaatgacctggcccatgtcttccagcacatgaatctgggaccggataatggaatcctccagcacctggcggttgggttctcccttctgccactggtcaatgttccgggccttaaaggatttcctggcctggtccgacatggccacaagccggtccaggtcttttaaggttgcaaaacggtatgtcataaatatcctcctgtcatagggtgaaatatctgctgccttgctgcttcgccgtggattgggttatatccagtatacagccattatatccagtatacaattgatggcctgcccagtcaataaaagagggggagagggaggtatggcttccggtacatatgctattgcattttaagtccgggctgattataattgtatatcatatgattttgcacagaagaaaggagcttaagcaagatgaacacagcactgacaagggaggcggccttagaggccctgaaaaaatataacaaggaaccctttcacatccttcacgcccttaccgtggaaggagtgatgcggtggtttgcccaggaccagggatatggggaggaagcggatttctggggaatcgccggcctgctgcacgacattgactttgagatgtatccggagcagcactgcgttaaggcgccggagcttttacgggaagcaggggctgaggatgggctgattcatgcggtgtgcagccatggatacggccttgtctcagacgtgaagccggagcaccggatggaaaaaatcctgtttgcatcggacgagctgaccggtctgattggggcggcagccaggatgcgcccatccaagagcgtcatggacatggaggtgtccagccttaagaaaaaattcaaggataaacgctttgcagccggatgctccagggacgtaatcaaagaaggggctgagggccttggctggaccctggaagagcttatggacaagaccatccaggccatgcggtcctgcgaggcagctgtcaacgaagagatgtctctcttctgatttgtaaagaaaattccttcgtatattgaaaaaagacatgcaacggtatataattgaggggaaatgttgcgtgaattttctggaatgaaccgtaagtgcctgacttcaggcgcttatctgtttatgagaaggagggaatgtaatggttgctatgtattttgtaggagcaggttcgctgctggcactgttgtttgctgcctgtatgtttgtgcgggtcaggaaagaacctggaggagattctgagatgctccgtatatccggagccgtacaaaagggcgccaatgcgtatctgagacgtcaatacaaaggtgtgggaatattctttgcagccgtgtttgtcatcctgcttgcgatggcattctgcggctttttgagtttttttacgccatttgcattcctcacaggcggctttttctcgggtctgtccggattcatcggcatgcggacagccaccatggccaactgccggacagcccagggagcgtcccggaatttgaataaggggctgcgggtggcattttccgcaggctctgtcatgggctttaccgtggtggggctggggcttctggatttgactgtgtggtactttatattgaacagggcatttggagcgcttcctgaaagcgagcggattgcccagattacggccaacatgctgacctttggcatgggtgcttccagcatggccctgttcgccagggtgggcggaggtatctttaccaaggcggctgacgtgggcgctgacctggtgggcaaggtggaggctggaatccctgaggacgaccccaggaatccggcggttattgctgacaacgtgggtgacaatgtgggcgacgtggccggcatgggagctgacctgtatgagtcttatgtgggctccattgtatctacctctgccctggccgtggcagccgggtacggggtaaagggcgtggctgtacccatgatactggcagccctgggcgtactggcatccatcctgggaaccttctttgtaaagacagaggaggacgcatcccagaaaagccttttaagggcccttaggacaggaacctatatcagtgcggcgctggtggttgcggctgcctttgcagccatccgtttcctgctgccggaccatatgggcatatatgcggctattctctcgggcctggctgccggtgtgctcattggcgcggtcacggaatattatacatctgatacatataatcccaccaggaaactggccgaatccagccggacaggaggggccacggtcattatcagcggcctttcgctggggatgctgtccacggtggctcctgtggttatcgtaggcatatccgtgctggtcagctattactgcgccggcggccgttctgattttaatgcaggactctacggcgtgggcgtgtccgcagtgggcatgctgtccaccctgggcatcacgctggctaccgatgcttacggaccggttgccgacaatgcgggagggatagccgaaatgacccacatgccgccggaggtgcgccagagaaccgatgcgctggattccctgggcaacaccacggctgccacgggcaagggctttgccattggctcggccgcgcttacggccctggccctcatcgcctcctatattgataaggtgaagcagattgacccgtccctggccatggatttgtccatcaccaatcccacggtgctgattggcctatttatcggcggtatgctgccgtttctctttgcggcccttaccatggaggcagtgggcgaggcggcccagtccatcgtggtggaggtccgcaggcagttcagggacatgaaaggactgatggagggaaagacagagcctgactacggggcctgcgtggatatgtgtactatttcggcccagagactgatggtggctccggccatggtggcagtcatcataccggtggcagtgggacttctcctgggaccggagggcgtatccgggctgctggcaggcaatacggtcactggttttgtgctggctgtcatgatggcaaatgcaggcggggcctgggacaacgccaagaaatatattgagagcggggaactgggcggcaagggcagcgaggagcacaaggcggcagtcataggcgataccgtaggcgacccctttaaggacacctcaggcccgtccatcaatatcctcatcaagctgacaagcatggtatccattgtatttgcaggacttgtggttgcggtgcatcttctgtaaggccatgaaaggtacggccgcgggccggggtgaggacattctctgcagaaaagtcctccatacaaagacatatgtctcctgtacgcaaattttctgctttaaaagtattgacatacataacaaagtaaggtattatttgcacttgtaacgccatacatataaagtggcatttattttatgaaaatacgctccatatccggcgcatagaaaagaaacaagggagacagacaagatgaaaaaagtggtgaagttcggcggaagttcattggccagcgcaagacagttcaaaaaagtagcggatatcattaaatctgataagaccagaaggtacgtggtcccttccgcaccaggcaggcgaaacgacaaggacgagaaggtgacggacctgctctatgcctgttacgacgcggttgcagaaggaaggtcctataagaaaatcctggaaaagattaagagcagatacatggatatcattgacggcctggatttaaacctgaacctggaccatgagtttgaccggatagaggaaaatttcctggcaaaggcaggccgggactacgctgcttcccgcggagaatacttaaacggtattgtggcggcccatttcctggggtttgaatttgtggatgcggcggaagtgattttctttgatgaaaacggaaactttgaagcagaacataccaaccgtgagctgtccgagcgcctggagcatgtggagaaggccgtcatccctggtttttatggttccaagccggacgggaccatcaagacattttccagaggcggttcagatgtcactggctccattgtggccaaggccatccatgcggatatgtatgagaactggacggatgtgtccggggttctggtgacagacccaagaattgttgataacccggaagtgattgagactattacatacaaggaactgagggagctttcctacatgggggccagcgttcttcatgaggacgccattttcccggtgcgcaaggaaggcattcccatcaatataaggaacaccaaccgtccggaagacaagggcactctgattgtggagagcacctgccgcaagccccattacaccatcaccggcattgcgggcaagaagggattctgctccatcaatatagagaaggccatgatgaacgccgaggttgggtttgggagaaaggtgctcagcgtgtttgagcagtacggcatctcctttgaacacatgccttcaggcattgacaccatgaccatctatgtacaccagtcggagtttgaggagtttgagcagtccgttatcgccggaatccacagggctgtggagccggacacggtggagctggaatcagacctggcgctggtggctgtggttggacggggtatgcgttccaccagaggaacagccggccgtatcttttccgccctggcccatgccagggtcaatgtaaagatgattgaccagggctccagtgagtggaacattattatcggagtgaagaacgatgatttcgagacggcaatcagggcgatttacgatatattcgtaaccacggaactgtaaacagtctgtttccgtattgtactaaggaggcttcgcagggataatttccctgcggggctttttctgagatggggcacagcaggcttttgcgcctaatttttcattttattatagttgaaagtgtgatatactggataaaatagtaaacaggaagagaaggagggggccatatgcttgaaaaaattgatttaggcaataaagtggacaagaagacgtaccgcaaggtcatggacgaggcagaagaaaagcttgggcttttgcagagggagtgcaaggatgcgggaattccggtcattctcgtgtttgagggaatgggggctgccggcaagggagtgcagattaaccgtctcatacaggccctggaccccaggggctttgacgtatatgcctgcgaccgccccacggaggacgagcagatgcggcccttcctgtggcgctactggacaaagacgccggccaagggcagaattgctgtctttgaccgttcctggtaccgcagcgtccaggtggaccgttttgacggccttacccctgaggacaagcttggggatgcataccaggatatcctgtcctttgagaagcagctgtgtgatgacggcactgtcatcatgaagtttttcctgtatatagacaaagaggaacagaagaaacggtttaagaagctggagggttccaaggagacttcctggcgggtgacgaccgaggactggaaccggaataaggactttgaccggtatctgaagatgaacgaggagatgctggaaaagacagatacggattatgcgccatgggttatcatagaagccgtggacaaggactatgcagcccttaagattgtgagctcggttatggaccgcctggaatacgagctggaacaccacaggctccggggcggaaatccggtacagaagcaggaggtcaagaccagggaacggtttaaaaacggcgtgctctccggcatagacctctccaaaagccttacggaggaggagtataagacccgtcttaagaagcttcagaagcggctggcagagcttcacagcgagctctaccgcctacggattccggtggtcattggatttgagggatgggatgccggaggtaagggcggagccatcaaacgtctgaccagcaatctggaccccaggggatacagggtgaatcccacggcagctcccaatgacattgagaaggtacaccactatctgtggaggttctggaacagtgtgccgaaggcaggacatatcgctatctttgaccgcacctggtatggaagggtcatggtggagcggattgaaggattctgttccgaagctgagtggagaagggcttaccaggaaatcaacgagatggaatcccacatggccaatgcaggcgctgtggtccttaaattctggcttcacattgacaaggatgagcaggagcgcaggttcaaggagcgccaggccaatcctgccaagcagtggaagattacggatgaggactggcgcaaccgggagaaatgggaccagtatgaggaggcggtcaatgagatgctcatacgtacttccaccacctatgccccatggattgtggtggagggcaatgacaaacgatacgccagggtaaaggtcctccagaccgtggtggatgccctggaaaagaaaattaaggaagtaaagacagacaaatgagtgagacaaaccatgtaattgtgattggcgcaggggctgccggcatgctggcagccatagctgcggccagggaaggcgcggccgtggagctgtgggaacagaatgaaaagccgggcaagaagctgttcatcacaggcaagggacggtgcaatgtgactaacgcctgcgatatggaggagctgcttggctccgtggtaagcaattccaaattcctgtacagcagtttttacggttttaccaaccgggacatgatggatttgctggagcaggcgggactgcgccttaaggtggagcggggaaaccgggtgtttccccagtccgacaagtcgtcagacgtcatcagcaccctgtccggccttttgaaacaggcaggggtcagggtgtgcctgaaccagaagacagagggactggtggtggaagataatgtgtgtaagggcgtgcgcgccggcggcaggatacagacagcagaccgggttatcgtggccaccggcggactgtcctatcccgccaccggctccaccggcgacggccttaagtgggccgctgacagcggacaccggattacggagctgtccccggccctggttccctttgaggtgagggagacggagacagctagggagctgcagggcctttcgcttaaaaatgtggaggctgctgtatacgacggaaaaaaggaattataccgggaattcggggaaatgctgtttacccatttcggggtcagcggccccgtgcttttaagcgccagttccttctgcgccagggccataaggaagcggcctctgcgcctggcgattgatttgaagccggccttgtcctgggagcagctggacgagcgcattctcagggatttttcggacagccggaacaagcagtttaagaatgccctgaaccatctttatccggcaaagctgattccggttatcattgaccgcagcggcgtggacccggataaaaaggtgaatgaggtcaccagggaggagcggcgcagtctggcggaagccaccaaggccctggagtttactctgaccggactcaggggctataaggaagccatcataacccagggcggcatatccgtaaaggatataaatccctccaccatggagtccaggaaggtaaggggcctgtatttcgcaggggagatactggatttggacgcagtgaccggcggcttcaacctgcagattgcctggtccacgggctgggcggccgggaaggccgcggcattatagcgccaggggcgcggaccgtggtatgggcgcggaccgtggtttgggcgcagcaggatacatgaatagaatcaattacatgaacacaggacaggagagaatacaacacatggagtatttcaatattgccattgacggtccggcaggggccggtaaaagcaccattgcaaagctggctgctaaaaagctgggattcgtgtatgtggatacaggagccatgtaccgttccatggccctgtattttatcagacagggtatttcgccggaggatgaggagtccatagccagggcctgcggtcaggtggaggtcaccatccgctatgtggatggggcccagcaggtgattttaaacggagaggacgtatccggtctcatacgggcggaggaagtgggccgcatggcgtctgccacgtcagtgtacgcaccggtcaggcagaaactggttcagcttcagaagcagctggccagggaagcggatgtaatcatggacggccgcgatatcggcacctgcgtgctgccggatgcgcctgccaagatttacctgacagcctccgtggaaatccgggcaagacgccggttcagggaactggaggaaaagggggaggcaagggatattaaggaaattgagaaggacatagaggagagggattaccgggacatgcaccgggaaaattcgcctttaaggcaggcggaggatgccctgctccttgatacctcccacatgaccattgaccaggtggtggactccatcatacgcatagccagggagcgggggtatgagggatagccatggacagaaaagtaacagtagcaaaaagcgccggtttctgctttggcgtggaacgggctgtggaccaggtctatgaacagatagaagccctaaagagcggcaggacgtccggccccatctatacctacggtcccattatccacaatgaagaggtggtaaaggatttgtcggataagggcgtcatggtcctggaaacagaggaggagctgagagcccttccccggaaccaggggacggtcatcatccgttcccacggcgtcagccggcatgtgtacgagattttaaaggagcggaacgtggccgtcgtggacgccacctgcccctttgtgaagaaaatacaccgcattgtggcggagcattccgcggccggggaggcagtggtcatcatcggaagtccggaccatcctgaggtggaaggaatcaagggatgggggaatgaacatactacggttataaaggatggggagggggtagataactaccgtctgccggagggccgaaagttatgtatcgtgtcccaaacgacatttaattacaacaaatttaaagaattagttgaaaaatttttaaaaaagggttatgatagtagtgttttaaatacgatttgcaatgcaacacaggaaagacaagtggaggcagcaagaattgcttcgcaggtggacgccatgattgtgattggcggcaggcattcttccaacacccagaagctttacgagatatgcctcaaggagtgtaaagacaccttttacattcagacactcggcgatttagatcctgacagtgtatcttctgtgcgcagcgtaggtattacagctggggcatccaccccaagaaaaattattgaggaggttcataccagaatggcagagcaaagttttgcagagttattaaaggaagaggaagaatcaaccaaaccaatacgtacaggagagatagtcaccggtcaggtcatcgaagtcagcaaagatgagataatactgagtattgcaggtaataagtccgagggtgtcatcacacgggacgaatacagcaacgacagcaacgtggatttgaccacaaaagtacagattggtgaagagatggaagccaaggtcattaagcttaatgacggcgtaggcatggtttccttatcctataagcgtatggcagctgacagaggcaacaagcgtctggaagaggcatttgagaaccaggaggttctgacagcaaaggtagcacaggtattagacggcggcttaagcgttgaggttgagggcgcaagggtattcatcccggccagccttgtatctgacagctatgagaaggacctgtccaagtatgcgggacaggatattgattttgttatcacagaattcaatcctaagagaagaagaatcatcggcgacaggaaacagcttctggttgcacagaaggcgaagctgaaggaagaactgttcgcaagaatccagccaggcgataccgttgagggtatagttaagaatgtgactgactttggcgcatttattgatttgggcggtgcagacggacttcttcatatttccgagatgagctggggccgtgttgagaatcctaagaaggtattcaaggcaggcgaccaggtaagggtactgattaaggatatccagggagagaagattgccctgagccttaagttcccggaggctaatccatgggtcaatgcggctgacaagtatgcggttggcaacgtggtatacggccgtgtggcacgtatgactgatttcggcgcatttgttgagctggagccgggcgtggatgcgctgcttcatgtatcccagatttccagggagcatgttgagaagcctgctgatgttttaagaatcggccaggagattgaggccagagtggtggactttaacgaggcagaccacaaaatcagcttaagcatcaaggctatgatggcgcctgctgcacaggatgcagacgtggcagacgtggatattgatgcaatgtcacagtacacagaagaataagatttgaattcatcaggactggttatgggttttggcccatagccagtttttttgggctctttgtcaatagttggggtgggatttttgatgcttaattaccatatcagcttgtgaccgtgccgggttccgtgctatactggaacaaaaaggaaaaacaggaccggacacaggctgcggtgcagcaggaaggggacggcatgaaggtgcgatgcagcgggtgcggcgccgtatttgactatggcgccaacaggggaatctgcccctgatgtttggagtacaatgtatggacaggggaggtgacggttccggcgtaccaaccgtggcgccgtttttatgaatataactatgacagcgaaagctggtccgggacaggggataagagggaaaacccgtataccagtgctatctggtggaccaggatgcggatgagatggacctgattctttggtgtgtgacatacggcggggaatcggagggttatgagggatactggcagatacgtgtccgcttaaggataccgcctgccggggcatccgttacatacggcccggaggagaacggggaaaataagggagggacacagggatgtctattccggcgcagcgtcatggttttcggccggtttgataagaaaatggaggcagccatagatgaaatctttggctccatacgaatcagcagcctggaagagactatttcatagcagggttcagaagcagggatgcctcgaagattccattgccgtagtcaaattttaagatgccgtgataccgttccaccagataccggacagaggtggtgcccgttcccatatcctcacgcttggaggagagaaagcgtccgtccttcatccgtatgaggtgggaataggtgttctgtatggacatggcaatcatggactctccggcctgtccgatgttgatggtgatggaaggggtgcccagggtctgcctttggcatgcctccactgcattggagagaaggttgcccaggatggtgcagaagtcaatctccggaaccggaaggttctggggcagggatatggaggaattcacggaaatcccctgggactgggcggtctgtatgtaataattgagcagggcattggaggaggggttccggcagtactgggtggtgtccagggtcttgtaggagcccagatagtcgttgatgtactccagggcgaattctgtttctccctgttccagcagccctttcagggtgatgagatgatggcggtaatcatggcgtgcttttttgaattgttccaggttatactgcagcgtggccatctgggatttctggacactggccagcagccgggtggtgcggtactgctccttggccgcatagctttcggccagccgtgacaaaatcctcagacttacatagtggactgtataaatacaggcaaaccagcagacagcaaaaaagaccatgtcaggatgatactgaagcatgcggacaggagacagggagcgggatgccaggcggaacatgatgaaaaagagcaccggaatggcagccagatagttccatacaggaagaagccgtgtgtattccactgccttggtcaggtatttgtgcaggatgtaataggccgcccagaccatgagaaacagaaaaataaggctgcttaacagctcgtctcctgtgataaaggaactgctctcatgaagggaggcagaggcattggacaggtcggcgcagtatccggcggtgtccgtgaagttcttgaaaaggaagagggaatagatggtcacaggccagtctgtccgcaccatccatttgcacaccagtatgttggtggtcatggtggtgcaggcccatgccagctctaaccagggctgattcagaaagtgacggaagcaggaaagacacagaaagtatacaaaaaacaggtatcccataagaatacctgcggtttttggcatagtataccgccactccttttggaatactgccagaaagggaacaatgatgaatatgatttcagccaaaatcatacatatcagctgtagctgtgcaaagcccatcagacgcctccgtttagcctggagaactggtaatctgcatattgctgatgaatctgcgaccgcatggtcctggtaataggcagatgttccccggttgtcaaaatgaactcggctctctccatggagaataccttgtccatattgatgatgcaattccggtagcagcataggaactgggagtaggcaaggagcataccggaaaaatcttcaaaccgcatataagttcggaccgtcttgtccggaagatggatttgtatgtagtggtttgagtaatctgtgtaaaggatggcgtcgatgggaatcttcaccatgatgcggctttcctttacttctatatagtgactctgctttctgcgggtcactgacttaaaatactccatggtctggctgaacttctcatagcggatgggcttaaccatatagtccagggcgcggacctcaaagcccttcagagcaaaatccgtgctgctggtggtgaatacaatggtgcaggattcgtcatccctgcggaccttttcggcaatacggatgccggaagtctcattccggagaaagatatctatgaatataaggtcaaagctgcccttttgccagcagcgaaggaagtcggcggctgtattgaagatggtcgtctgctggcaggtatgtgtgtcagaacaataggtggatataaagccggctaactgacgagcttcatctatagagtcgtcgatgactgcaatgttcacggtgcccttcctttcttttgtatgacaacagggtaacaaaagccatataaattatcctgtcacggtacgttatgaaacaatccatataggttcagtataatatacaacaaattaaattgcaagggcaattggaataagttgtaagtcggtataggcaggcccctgcctgggtataatccatttgtacttaatttgcatcagtaagaaaggagcaagaacctatatgggaaagtctaagaaaaatgaggcctttaatccccatgacctgagcgcacaggaccagcttaagtttgagattgcccaggaactgggactggatgccaaggttatggaaggcggatggagaagcctgacagccaaggaaagcggaaagatagggggacttatcaccaagcgcaaacgggaacttaagaaagaggcattgcagcaggaatgattttccgatatactgttttatatctgtaatcaggcaagatacaaaggagacggaaatgaagatagggataatctgctttacggcaaggggcgccggagtatgccgcctgctgtgcagccggttcagggaatcaggaacagagtgcgcaggatatgcgccgcggcgcttctggaagccggaatgggagtgtgagggaatcctgcctcaggacaagtccctttcagagtggaccgggtccatgtttgaacagaaaagggcgatggttttcatcggcgcagccggcattgcagtcagggccatagcgccctttgtccgggataagatgacagacccgcctgtggtggctgccgatgaggccgggcatttctgcattccccttttgtcaggccatgtggggggagccaatgagctggcggaacagatggcgggctggctgcagggcataccggtcataaccacggcaacggatgtcaacggcgtgtttgcagtggatgtctttgcggcccgcagcggcctctgtatcacggaccgggaaaaggcaaaacagatttccgcctggctgctggaaggcgggaaggtaggaattttttgcgatgcagagtgtaaaggggctgtggaaacggatgaccaccggcgcctgggaaaatgcattgccgggcataatatatgccggtattttacatgcaggcataacatatggattacattccgaaacagtgaaaggccggcagcggtacaggccggggatgcggtccgggaaacggaagcagccggggaaacggaagcagccggggaaaaggaaatggtccgggaaacggatgcggttttggagggggccgtaataccatccttcctccgcctggttccaaagatggtcgtggtgggcgtgggctgcagaaagggaactgcgccggatgtcctggaacgccgtgttctggaagcgctggaggatgaaggcattgacctggcggcggtaaaggcattggccaccattgatataaaggcccgggaggaggcggtgctgcagctggctggcaggtatggatgggagcttcggacttttacatccgaagaactgcaggcggtggaaggggtatttgaggaatccgggtttgtaaggtccgcggtgggtgtgggaaatgtttgtgaacggtcctgtgcggctaggggaggaagtcttctgatacataaacgggcaggggagggcgtgacagtggccgcagcgctggagccggtccggacggctgctttccgcagtgttcagtgattgcggggatgcgccggagaaattagacattgagaaatacagttggatatgatatacttttttccatagtttaaaagtcagatgttggacagcgggtgatactatgggagattcgtacatctataagaatcagaaaaaattgagatggggatacaccacaggtacttgtgcggcagcggcttccttggcagctgccgttatgttgttgcaggacagaagaatggagcaggtatccctgacaaccccaaagggagtccgtctggacctggaggtggaggaaatggagacaggaaaaaaatatgtctcctgcggagtcaggaaggatgcaggcgatgacccggatgtgacggacgggcttatggtgtattccgtggtccggatgccagggaaggatgatgcagataccggtggggattatgtgtatgaggaggacggattttgcctgaatttatccggcggagtgggagtgggaagggtgacacaggacggtttgagctgtgaagtggggaaaaccgccatcaacccggttcccaggcagatgatattcagtcaggtggcaggcgtttgcagggaatccggtttcaaagggattcttttcatcgaaatacgtgtacccggggccattaaggtggcggataagacctttaacagccgcctgggaatccaggggggcatatccattctgggaaccagcggaatggtggagcccatgagcgagacagcccttctggataccatccggctggagctgaggcagagaatcaggaagggagaaaagattcttctggtgacgcccggaaattatggcgagaactttgtcggcaacgtgcttggccttggcctcgggcaggctgtgaaatgcagtaactttataggcagtaccattgacatggcagtggaggaaggggctgaagccgtactgctcataggccacggcggaaagctcatcaaactggctgcgggcattatgaatacccattcctcctgggcagatgggagaatggaaatcctggcagcccatggagctgcctgcggtgcaggaagagaactggcagaacagattctggaagcagtgaccgtggaccaggggctgagccttctggaaacagaggatggcctgcgtgaacaggtaatgaagcgggtgacggaacggctggaacagcatttgaaacggcgggccggtgaacgcctgagggcggaggccattgtatttaccaatgagcgcggaatactgggaaaaaccaccggtgcagatgatttgcttatgtactttacggacagaacaaggaatggatgaaaggcggaacaagatgatacatatagtaggagcaggtccgggcgcagttgatttgattacggtccggggacagaaacttcttgcagaggcagatgtggttatttatgcaggttccctggtcaaccgggagcttctggactgggccaggcaggatgccaggatttatgacagcgcatccatggacctggaacaggtcatggaagtgatggagcaggcggagagggacgggcttaccacggtgcgcctccataccggggacccctgcctctacggcgccatacgggagcagatggactgtctggatgccagagggatagagtacgatatctgccccggggtcagttccttttgcggagctgccgcggcactggggatggagtataccctgcccggcatcagccagagcgtggtcataaccaggatggcgggaagaacgccggtgccggagcgggaatccatcaggcgctttgcgtcccacggcagtaccatggtgatatttctgagcgccggtatgacaggtgagctgtccgcagaactgatggagggcgggtatccgggggatacaccggctgccattgtatataaggcaacctggccggatgagaaggtggtccggtgcacggtagccaccttaaaggaggcggcacaccgggagggaatccataagaccgcgctgattgcagtgggagattccgtggcccagagcagctacgagcgttccaggctttacgaccctgccttcaccaccggattccgtgccggaagggatgctgtctccggaaaacaggagcctggaacactctatgtggtgggaatgggacccggagagcgaaaacagatgacaggacaggccctggaagtcatggagcagtgccaggtcattgccggatacacggtttatgtggacctggtaaggggattgttcccccaaaaggagtttttgaccaccgccatgaccagggaggaggaacggtgccgcaaggcatttgaatgctgcctggagggaaagaatacagccatgatatgcagcggggacgcaggggtctacggaatggccggtcttatactggaactggcggaacagtatccaggcgtcagcgtcaggatagtgcctggcatcactgctgcctgtgcaggtgccgcaatactgggagcccctctgatgcatgattttgcagtcattagcctgagcgaccggctcacgcccctggaagatatatggaaccgggtggaggccgctgcacgggcaggctttgtcatatgcctgtataatccggccagcaagggacgtcctgactatttccgtcaggcatgcggcaggattcttaagtacagggcgggaaatacggtatgcggactggctgtgaatataggcaggcaaggggaagggatggaggtccttaccctggatgagctgaaggaccgccaggcggacatgtttaccacggtttacatcggcaatttccataccaggcagattgggccctatatggttacgccgcgaggttacaggtatgaaggaaaataagaggaacatcctgctgtttgccggaaccacagagggaaggcagctggctgagtatcttcaggaggcgggacagccctttgtaatctgtgtggccacggattatggaagggatttgctggaggatatatggaagacggaccatgccgggtgtatggaagtacgccagggacgtctggacgcagcggagatggagcagatgctttatgagctgcagccggcgctggtcattgacgccacccatccctatgcagtggaagtgacggaaaacataaggaaggcgtgctccaatagagccggactgcggctgataaggtgcctgcgtgaaccgggagcagcttatatgccggatgtggtccatgtgccggatgtggaaagcgcagccgcatggctgtcctctgtgccgggaaatatcctggtgacaacgggcagcaaggagctggatgcgtacactaaaatagaaaattaccagcaaaggatttatgccagggtcctgccctcggcggaggctgtggcgctgtgcagaagcctgggatttgaaggacgccatattatcgccatgcagggccccttttcagaggaaatgaatctggtgcagctcagggaatatgggtgcgcttatctggtgaccaaggacggcggcgcagccggaggctttgcagagaagatgagagcggcccagaaggccggtgcagcggcagtggtgattgacaggccgggcagcggagaaggcgtatccctggaggagataaagggacaggtaaaggagtggatggaccatgaaaagagatgaaccatatatggatgatttaagaccaatcgtatatcttgtgggcatagggatgggaggagaagaccagcttacgggccgggcaatggactgcctggaggcagcccaggtggtgatgggggcggaccggatgctggagagcgtcagcgcctacaccgacaaaaagcgggtgttttcagcctataagcccagtgagatggtacagtggctgggcagtttccgatgggacgaagcagccctggtgctttcaggggacactggtttttacagcggggccgaggcagctgcaaaggcatttctccgggaagggtgggacgtggaatttgttccgggcgtgtccagcctgtcctatttctgcgccaggttaggcaagagctggcagaatgtccatccggtcagcagccacggaagggactgtgatgtggttgcccatatccgcagcttcagaagctgcttcatcctgctgggcggggcgggcagcgtaccggatttgtgccgtcagctggtcagcagcggaatgagcaacgtgaccatatgggcgggagagaacttttcatatgaggatgagcgcattgcctgggaaatgacgcctgcagagcttctgatggaggacgagcgccttccctttggaagtctggcctgtgtgctggtggaaaacacagaggcggcagaaggacagctttatccccaggcaggccctgaggatgacgactatatccgcgggcaggtgcctatgacaaaaaaggaggtccgcaggatatccctggaaaagctgtgtatcggcgcccaggccgtgtgctatgacataggagccggtaccggctccgtggcagtggagatggggatggagatacgcagccggggcggcagcggacaggtctatgccattgagcggaacagggaagccctgcagctgattgaatccaactgccagaaattccacggaagctggatgggttttcacattgtggaaggcgaggcgccggaagctatgaagggactggaaccgcctacccatgcatttattggcggaagcggtggccatatgcgtgaaatcgtggcagcccttctggaggccaatccccgtgtgagaattgtggcaaatgccattacactggagacagtgggcgagattctggcctgcatgaaggaattcggatttgcttcagcagagattacccaggtatgggcggcgcctgtggatacagtgggaagctaccatatgcccagggcccagaatccggtatatgtggcagtcatgcaggaccccaaagaggacgagggggatttgcaatggcaggaattatgatagctgctccggggagcggaagcgggaagaccatggtgacctgcggcctgctggctctgcttaagagaaagggatatcatccggctgcatttaaatgcggcccggactatatcgacggcctgttccaccgcagggtgctgggagttgaaaacggcaatctggacagcttttttgaaaccccagcccatatgaggcggaaattgcgccgcagcatggagagccattttgtggtggcggagggggtcatgggatattttgacggcctgggcggcgtgtctgtccgcggcagctcctttgagattggccgccttctcggccttccggccattctggtggtggatgggagaggggccagcttgtccctgatggcttttattcagggttttttggagtatgatgcggcggcagaaaatgatgatgagaaaaaaactcataataaatcctgcgatgacgcctgccatgatatggaatgcggagcagagacagaatacaagatgcaggaaggaaatgaggaaaaatatcgcgagaaaaaaactcacagaacggacagcgggactggggaccatgccgggagctctggctgcagcgtgaatcatgataaaataaataacaacataaagggtatctttttcaaccgcatgtctcccatgatatataaccgcataaagccaatggtggaggaacggtttcggattccggtcataggatacctgcctgaactggaattccttcaagtgggaagcaggcatctgggactggtgcttccggatgagatagagggaatcagggaacaactggagcagctggcggaccggatggatgaaaatctggaatgggagctgcttttaaagattgctgctgatgcagagggctgggatgtaagtgaggagggaaataaactcacttcaaattccggattggataatagggataatggggctgaaaccgggagccggatgcagccggaaccgggagccggaccgcgtttccgcctgggaattgccagggatgaggcattttgcttttattacggggataatctggaagccatggaagaggccggggcccagctggtgtatttcagcccgcttcatcagaaggagctgcccggggggctggacggaatgatactgggcggaggttacccggaaaatcatggcggggcgctggctgcaaacaggtctatgcgggattcggtggctgctgcggctgcatcgggaatgcctgttctggcggagtgcggaggctacctttatcttctggacagcctggaaggtgctgacggcagggattatcccatggcaggtgttttaagaggccatggatacagggccggaaagaccggcagatttggatacataacccttagacccaatgaagaccttccctttctgccggaaggggaggagataaaggggcacgaatttcattactgggactgcaggtgcagggcggacgaattccgtatgatggccctcaagccaaatggcagccgctgctggccctgcatgaggacagaggggcatgtaatggccggatttccccatctttattatccgtcctgcccggaattggttcaaaggtttgcggaccagtgtgtggaatatggaaagaaacaaggtaaggattatggaaagggatatgagctatgacattgagggaagcaatcggaacgattaagcccattgaccaggcaatcaggcgtcaggcgaaacagcactgggaccaggtggctaaaccattggaaagcctgggggtcctggaggaggatatcatacgcatcgcggcagcttccggcagcctggcagtcagcctgcatcccagggccattgtggtcatgtgcggagacaatggcgttgtaaaggaaggcgtgacccagaccggccaggaggtaactgccattgtggcaggcaacatggcacaggggaattcatgcgtctgccttatggccaggcaggcaggggcggatgtgattcctgtggatgtggggatggcctgccatgaggcggttccgggagtagtggaccggaaggtggcgtatgggacaaaggactttctggaggaacctgccatgaccagggaggaaacagtgaaggccatggaggccggggtgaatatggcctcagaacttaggaaaagaggatatgtgctggccggctccggggagatgggaatcggaaatacaactaccagcagcgccattctttccgttcttctggatatggaccctgagctggtgacgggccggggagccggtctcaccacagccggttacagccgtaaggtgcaggtcataagggaaggcatccgtatccacaagccgtccggagaggacccggtggacgcgctgtccaaggtgggcggtctggatttggcggccctgaccggtttttacattggctgtgctgcctgcggtattcctgtggtgctggacgggctcataacaggagcagcagctttggcagctgtcagaatctgcccggatgtaaagggatatcttctagcttcccacgtttcagctgaacctgccggggcattggtccttgaggcgcttgaactcaaacccgccatttcagcgggaatgtgtctgggggaaggcaccggcgcagcggccctgttcccacttttagacatggccgctgccgtgtatacacagatgagcagttttgacgatatccatgtggaggcatatgaacatcttgtatgatggaagattggcgcaataagaagatggatgcaatgagtagattggcgcaatgagtagattgatgcaacgagaagtttggtgtatgagaagattgatataatacgagcaggagattaagggatgattactctggtgacaggcggaagcggcagcggaaaatcagaatatgcagagggactgattctggattccccctgttcccgccgtttctatgtagctaccatgattgcatatggaaaagagggaagggataaggtgatgcggcaccgtatgcttcgaagcgggaagaaattcatcaccatagaaaaaccctgggacgtgggaaatgtggtgctggaaaaatatgaggcaggtccatctgcttcttccaggacagacagagtccttttgctggagtgtgtatccaatctggcggccaacgagatgttcagggaagatggtacggcagaggccgcggcaggcgcggagcggcagccatcaaaccggtcagaaaaccaggataaaggccaggatgaaaatcagaatgggaaccaggataaaaaccaggtcccatacctggctgacaagcttgcagcggacatcatttccctggcaggccaggtgcaggatatggtgattgttacaaacgaagtggaccgggacggaatctgctacggacaggagacaatggagtatatccgtctcatgggacgtctgaatcagaagctggcagctgcctccgaccgggtggctgaggtggtttacggcattcccgtgctccggaaaccaagggtttcccaagccgcggcagaagggattatattgccggaggggagtgatttgagaggaagggagtgtcagggaaaatgaacggactttattcctgtatcattgcggtttccatgtattccaaaatacccatgcccgctgtggagtggacccaggagcggatgcgctatgttatgtgctttttcccgctggtggggattgcagagggaacggttctgggcctctggctctatcttgccctggatgtcctgaatctgtccacggcggccgctgccctcataggggcagctattccaatcctggtgacaggaggaatccatatggacggttttatggataccatggatgctgtccactcctacggcgacagaagcaaaaagctggagattctcaaagacccgcacctgggggcatttgcagtgatttcctttggggtatacatgatgctctacacaggcgtcttttatgagtacctgtctcttgcccggatgaaggacactggggacagatattttctttacatggttccctgccttgtgtttgtgatggaacgcgccctcagcggtctttccgtggtcacatttccccaggcgaaaaaaaagggactggcggccggatttggaggggcagccaaaaagaaaacagattcagcggtgctggtcctgtggctggctggctgcctgggagccgccatggctgccgttgggacgggctgtcatggggcgggattagcggcatgggtaatactgtttacccacctggccgtgtttttatggtattacaggatgtcggttaaccagtttgggggagtgacaggggatttggccggatgctttctgcaaatctgcgaactggccgggctggcggcggcagccgttcttttgagagcaggattgatgggaggaatgtagaaatggtcttggtaacaggaggaagctcccagggtaagaaggagtttgtcaggcagcaccttgggagacagggggaggatgtatctgtctggacagagggctcagaggcttcctgggaggaattcatgaaaggaaggttctgccatgacttccatctctttgtcagacgtgtgatggagggaagcacaggcccgattggccatgaatccgaatggggatgggcagaggcaatcatgaaccggcttctggaagaactgtctgccggaccgccggaccgtgtcctggtgacagatgagattggctgcggcattgtgccggcagatgcctttgaacggctgtacagggaggagacagggcggctctgctgccggattgccggggaggcaaaggccgtatggcgggtgtgctgcgggatagggatgcggattaaatgacaaggtaggtagacatggatattacgtggctggatatatggaaatttcacggagcagccctgctggcgggatgtgtgattgactggatggtgggggaccccttatggcttccccatccggtgcgccttatgggaaccatgatttcctggctggaatcacggctcagaaaatgggcagcgggaccgggaaagcagaaagagaatcaggacagccagggcgttccccatgggaaagaagagcacacacagtgtcctggtcctgaaaagacaagggaagcatgggcaggtgtgctcctcactgcctctatgtgcgctctgtggtggtgcattccccgggcggttttttccgcagcggaacatctgctgctggccagggcctgggcagtgcttttgctggcagaaggtttcctgtgcagtctcatgctggcagccaggggattgtacacggaaagcatgaaggtgtgccgcagcctggaggcaggacggacagaggaggccagatacaatgtgtccatgattgtgggaagggacacttcggtactggatgagggcggaattgccagggcggcagtggagacagtggctgaaaatgcctctgacggcgtcattgccccctttttgttcatggcgcttttggggccggctggaggcgcgctgtacaaggctgtcaacaccatggattccatggtgggatataagaatgacaggtacctgtatttcggacgctgtgcagccaggctggacgatttgttcaatctgataccggccaggctgaccggagtcctgatggtccttggagcctgggtcctgcccgggatggacggagcccatgcctggaaggtgttcctccgggacagaaagcgccatgccagccctaattccgctcacggcgaggctgcctgtgcaggggccctccatctgcgtctggcaggggatgcgtggtactttggagcgcttcacaaaaagccctatataggggatgacggcaggaggatagaaccagcggacataagacgggcaaacctccttatgtttttcacagagggcgtcatggtccttggtctgggtgtcctgcttctgcttctgtgaaatcatttggtaattatcgtactatatcttcaaaaggaaaggtcactatgggaggttattatggaatatcagcacggcggagacatttacagccaggacatacagatggattattctgccaatatcaatccccttggaatgccggaagcggtaaagagcacgctgagggactgcctggataaggaaatatgcagcctgtacccggacagccggtgccgggaactgaggcaggccctgggcaggcatcatggggtggaggatgagtgggttatctgcggaaacggggcggctgatttgatattcggcctggccgcagcgctgcgtcctggccgcgggcttgtcccggctcccaccttttccgagtatgagcaggcattgaaagcagcggggtgcaggaccagctattattatctcagggaggacgccggattcgccccggacatatccggcatgtgcagctgtatcaaggaagcggcggagaggggagagccctatgatattgtgttcctgtgcaatcccaacaatcccacgggaatacctgctgaaaaggaagacgtggagcagctggcgcaaacctgcggaagtctgggggcgttcctggttgtggatgaatgcttctgtgattttttggaggattcagacgtatattccgtcatacctgacctgtccgggtttgggaatctgtttgtgctgaaggcatttaccaagctgtatgccatggccgggctgcggctgggctatggcctttgcagtgaccgctgcctgctggaacggctgcaggcagtccggcagccctggtccgtgtcgggcctggcccagcgggccggcgtggcggctcttagtcagacggattttgtggagcataccagagctgtaattaaggaggagcgtgagcggctggctgcagcactccgggacctgggttttaaggtatattcctccggggccaattatctgtttttcagggacccgggagaggatggaaccacggaaaaaggccggctttaccaggaactgctgcagcgccgtattttgattcgcagctgtgccaattatccggggctggattcttcctgctaccgtatctgtgtgaagctgaaacaggacaatgaacagcttatccgggaaatggcccgggtgcttgagaggaggaaacaatgtctgaacctgctaaaccaatcatgattcagggaaccatgtccaatgcgggaaagagcattctggccgccggactgtgccgtatctttcatcaggacggctacaggacagctccctttaaatcccagaacatggcccttaattcctacataacaccggaaggcctggaaatgggacgggcccaggccgtacaggcggaggcggcgggtattgtccctcatgcagacatgaatcccattcttttaaaacccaccacggatgtgggaagccaggtcattgtccacgggatttccaggggaaatatgaaggccagggactattttgcctgtaaaaaaacgctggttcccgatatcatggcctcataccggcgtctggaggaacagtatgatgtcatagtcatagaaggggccggcagcccggcagaaatcaacctgaaatccgatgatatcgtgaacatgggcatggcggacatggccgacgcgccggtgctcctggtgggggacatagaccggggcggcgtttttgcccagctctacggtacggtggcccttctgacagaggaagagagaaagcgcataaagggattaatcatcaacaaattccggggggacaggaccatactggagcctgggattgccatgctggaggacctgtgccatatacccgtggtaggggtgataccctacatggatgtggacattgaggatgaggacagcttaagcagccggctggagacaggaaagagaaggaccccggctgccgttgatttggcagtgattcgttttccgcgtatatccaattttacggattttaatgtattttccggaattccgggagtgtccctgcgctatgtttcaagggcctgcgaccttggcagcccggatatggtcatcctccccggcaccaagagtaccatccgcgacttattgtggatgcgtcagaacgggctggaggcggcaatccttaagctggctgaccgcagggtgccggtgtggggaatctgcggcggctaccagatgatgggagaggtgctggaagatgcaaagggcgtggaaacggaccgtccctcccgggtggagggaatggggcttcttccccttaaaacggagtttgaggaggaaaaggtaaggacccaggtggaaggcgccttcggcgagctggacggctgcctgggcaatctgtccggaaaatccattgcaggatatgagattcatatgggccgtacgttcattgaccgggaggaaggggctgcggacacggccagaatcgtttcctggcgcagggagccggagatatgccgccccatggattatgtgatggagacaggccaggacgggatattgtccagacaggccaggatggatgggtggaacagggggaatctatatggtacctatgtccatggaatctttgacggacccggaattgccggggcagtggcagaggcgctggcagcggcaaaggggctgaccctggagcaggctgcggacatggattatcccacttacagggaacagcagtatgataagctggcaggagaactcagggagaatctggatatggatgccgtgtacaaaatcatgggcatcaggcggaaaggagaggcgtaagcgtatgacggacatacagttggaacaggtgctgccgggggatatagagaggcgcagctttgaaatcatacaggaggaactgtccttgcagggcatacagctggagcctgaaaatgaacgggtcgtcaagcgggccatccacaccacggctgattttgactatgtacaaaacctggtgttttccagccatgcggtcaggaaagggatagaggcgttaaaagccggggcagttattgtcacggacaccaatatggggctgtccggaatcaacaaaaaaaggctgtccgctctgggcggggaagccttctgtttcatggcggaccaggatgtggctgaccaggcggggacacagggaaccactagggctgtggccagcatggaaaaggcggccaggctctatggcttacaggggcgtccccttatttttgccgtgggcaacgctcccacggctttggtccgcatttatgagcttataaaggagggactggctgttccggcccttgtcatcggcgtaccggtgggattcgtgaacgtggtccagtcaaaggaactgatacttacccttgaggacacgccctacattgtggcaaggggaagaaaaggcggcagcaatgttgccgccgccatctgtaatgcgctgctgtatcagattccggtgtaggaactggttgatgcgctgccgtatcagagtccggggattccctatttccggccgctccagcagtaggtgcagagcttgcacggtgagatgccgatggacttcaccaggtcatccagcctgtggtagcgcagggtggtgaatccaaggcgcttgcggatttcctcaatcatttctttgtaattggcgctgtccgggtctgtatagctgcttaaaacctcacgggacacatcatcgccttccctgtcccggatgattcttctggttatcaggtccagctctgaggtggaacgggagaagttaaggtaagggcatccgaacataaggggagggcaggcagggcggatatgcacttcctttgccccgctctggtacaggaattccgtggtttctcccagctgggtaccgcgcacaatggagtcgtcgatgagcagaagctttttattgcggatcagcgagtccacaggaatcagcttcatgcgggcaatcaggtttctctgtccctggttctgcggcatgaaggagcggggccaggtgggggtatatttaataaaggggcgggcaaagggaatgccggattcattggcatacccgatggcgtgggcaatgcctgaatctggaacgccggcaaccacctcgggctgcgcctcatcccgtttggccagcagctttccgcattcataacgcatgctctccacattgatgccctcgtagctggatgtggggtaaccgtagtatacccacaggaaggagcatatcttcatctcttccctgggagggctgactgtttctacgctctcaggcgtcatatatacaatctcgcccggacccagttctttgtagtccgtatatcccagattaatataagcaaagctttcaaaggaggcgcagaaggcatcgcccttgtgtccgatgacaatgggggtccttccgaacttatccctggatgcgtagattccttccggcgtcagcagcaggatggacatggagccctctatcttttcctgggcaaaaagaagaccttccaccaatgtggatttctggttaatcagggcagccaccagttccgtggcattgattcgtccatggctcatctccataaaatggatatggccgttttcataggctgaggccaccagctcggcctcgttgttgatttttcccactgtggttatggcaaagctgcccaggtgggactgaatcaaaaggggctggggttcattgtcggaaatacatccgatgcccagtgttccctccagctcgtccaaatccccgtcaaattttgtacggaagggagtgttttctatgttgtggatggaccttgtaaagccctggctgccgtatacggccattccgcctctttttgtccccagatgggagtggtaatccactccgaaaaacaggtccagggtacagctgttttttgatgcaacaccaaatattccgcccatatatcatacctcttttatctatgtgtttgttttacgcctttgtgattggtgccggcctgtctgccggttacggacttatcataacatatattagtagtacaggacaatatgattgatatattatttatacttatgagaaactataagcatggcaggaagggttttccggtgaatttcggttctgctccgggatgacaattccatacatttgaggtatacttgtgataaatctcacggagcagtacactccgggaagaggaggcttgcaggtgactgaatcagatggacagaacgggcaggataagcaggctatttgcctgacagtggccagggatggcagtggtgattacgatacagtaggagaggccctggcggcgctgggagaagcagaggggccgccggcctgcatattcataaaaaagggcgtgtacagggaacggctggaaatcagaaggccgcgccttacactggagggtgagtcggcggacagcacagtcatcacatacggcctgtctgccggcatgctgatggaagacggaagcaggcgggggacattccgcacctacagcgtgctggtggacacccatgattttaccgcaaggaacctgacctttgaaaacagcgcgggtccgggggaagaggcgggacaggctctggccctgtatgtggacggggacaggattctgtttgagggatgccggatgctgggaggacaggacacacttttcacaggcccccttcccccaaaggaaatccaaaagaacgggtttataggaccaaaacagttttcccccagaataaacgggcgccactgctaccggaactgttttatctgcggggacatagactttatattcggcagcgccacagcctactttgagaaatgcgaactatattccgttggcagggacgcagaaagaaagggatatgtgactgccgcatccacccccaggggccagagatatgggtatgtgttcagaagctgccggtttacgggaaacagcgccggagaaagcgtctatctgggccggccctggagggattacgccaggacagttctcattgactgctatctgggtccccatatatgccgtgaaggatggcatgactgggataagaaggaagcgcggtccaccctgttttacggggaatatgcaagctatggaccgggagcagcggaccggggagcagcggaccgggatataacagaccggcaaccgccgcaacatggctctcccaggccggactgggtggccgtgcttacctgtgagcaggcacaggactacaccatggaaaaggtgctgggcggagcggacaggtggaatcctggggaacaggcatacatttaagaaggaagggacatacgtatggatttataccgtatcatactggtggatgatgaggaagaggtcaggcagagcatcatcaggaaaattgactggacgggagccggtttccaggtggttggagatgcagagaatggggaggaagccctggaaaaggtggaggccctggagccggacgtgattctgacggatatcaggatgccctttatggacggtctttccctggctgaacgggtgaggcagaaatacccctcagtgaaaatcgtgattttttcaggctacgatgattttgagtatgccaagcaggccattaagctgaatgtgacggagtatatcctgaaaccggtgaacgtggaggagctgaccgctattttaaagcgcatcaaatccaatctggacgaagagattgagcagaaacggaatgtgaacctgctgcgtgaaaattatatacgcaaccttcccattctcagggaccagttcttaaacgaactggtgggaagcacggtgcccggacaggtactgaaagaaaaactggcggagtacgacattcctctggcaggagccaagaagtgggtggctgcagccattgacatagagccggaggaaatcagggaggggaacatactgcctctccacaaggagagggacctgattcctatttcagttatgcagattgtggaggaaaagctgggaaactattgccggtcatccgtattcacctcttccaggacctcctggtctgaactggcccttattgctgccattgacggggataacagccagaccggcctcattgacgtgctgggggatatctgcaaggagacaaagaagattctggaggtgcccatcaccattggcatcggccacagctgccaggacctgggggaggtcagcagttcctataaggcggccgtggacgcccttggctataaggcaattgtgggggcgggaagcaccatttacatcaatgacgtggagcctgtaagcgggggaaagctgagttttgacggcaaggatgaggcggagcttattgcggccatcaagttcggtcccagggagaagatagaggaagcggtacaggcggtcatggataagatgagcgatgcaaaggtgcatttcaggcagtgccaggcatatatgctcagcgtgtccagctccattgtccagctgattcagcagtatgacctggacctggaccagctgacagaggaaggggaagagcagggagatacctttgccgtcatacccaggatgctgaaaaaggaagactttgcccactggctgctttccgccgcagtcaggatgaaccaggccatgaaccaggaacgggataataccatgaagcaggtcatccagaaggccaaggaatacattatggacaattatcaggacccggatttgtccgtggagaaaatatgccgccagctgcacatgagtccggcctatttttccaccatgttcaagaaggagacagggcaggcctataccgcctacctgacccaggtccgcctggacaaggcggtggagcttctcaacaagaccgacgacaagacctatgtcatagcggccaaggtgggatatcaggagcagaactatttcagctatgtgtttaaaaagcgctttggggtttcgcccacaaagttcagaggggcaaaatagatacagcaggcctgtcccgccgtgtgcaacgggactgaggcaggccgcgtaaaggagcaggggacatgttgtttgagaagcagaggattaagctgcagaaggccagcatacggtatattatattcatctactttacgctgacggccctggccgccagtatatttataggtatttccctgtattccaggctgtcgggccagatgtccgccaccatccgggaggagaaccagattctgattaatcagataaccaggtctatggaggattacctgcgcaccgtgatgaagctgtcggattccctgtattacggcgttgtcaagaacgcggacctggcaagcggctccatcggaagcgagatgacccttctctacgacaacaacaaggacaatgtggagaacattgccctgttgtccaaagaaggaaagctgctggaatccgtgccggcggcccgtcttaagaccaatgtggatgttaccggggaaaactggtttacctcctccctggaaaagacggaaaacatgcacttttccacgccccatgtccagtacatctttgacggcagcgagaaccagtaccggtgggttatctccctgtcaagggcggttgaaatcacccagggcccttccacggaccagggcgtcctgctgattgatatccgctacagcagtctggagcagctgttcgacggggtaaacctgggaaacggaggctatgtctatctgattagcagcagcggggaaatcatataccatccccaggcccagctgattgactcgggaatcgtccgggagaacaacctggaggtatccggcctcagagacggcaattaccggcagaccgtggatggggtaaaacgcactgtcaccgtgaagaccgtgggatacacgggctggaaggtggtgggggtgacgcctcttgacggtgtgtccctgaacaacatcaagacaaagcttctggtgatttttatgattgcttttgttctctttatcatgaccatcatcaattcctatatctcatccaggataacagaccccatcaaggaactggaaaaatctgtaaatgaaatcgaggcaggcaacctggaaacagaggtcagaagcggaggctcctatgagatacagcatcttggcaattccatacagaacatggccaggcagatacgcaggctgatggacgatattgtggcggagcatgaatccaaacgaaagagcgaattcgataccctccaggcacagattaacccccatttcctatataacaccctggacatcattgtatggatgattgaaaatgaaaacctgtccgacgcagtgcgggtcgtgacggccctggctaggtttttccgcatcagcctcagcagggggaagagcatcatcacggtcagggacgagctggagcatgtgcgcaactaccttatgattcagcacatgcgctataaaaacaaattcacctacacggtggaagcaggggaggatgtcactgacctggccagccttaagcttatccttcagcctcttgtggaaaatgccatctatcacggcatggaattcatggacggagacggcgaaatccgcatcagggcatggcgccgggacaaggatttgtatatgagcgtatcggacaacggcctgggcatgacccgggagcaggtgaaacggctcttcggggatacggaccatgtgccgtcgggcagaggctccggtatcggggtcaggaatgtgaacgagcgcatcaggctgtattttggaaacagctacggactggaaatagagtcagagccggatgacgggacaacggtcacggcccatctgccggccatcccctatgaggaagtaaagaatacggaaagtccatgataaatagaatcgtggaaaggtgaggaagcctatgttaaataaagggaaaattctctggtgcatatgggccggtatcctggtcctgctgtttttgatgtcctccacggacctgattatcacggaaaagaaagttgaggtatatcccatttccgttatcgtggagggtgataacgacgattactatgtgaatttcaaaaagggtatggaccaggcggcggtggagttccatggggacgtcagcttcatcaccctttatgccccggatgaccaggcgcagcagatggagctggtaaaaagggaaatcagggacggaaccagggcggttattctggcgccggtgaagacggaggaggctgtaaaggagttggaggacatgagtcccggctgccctgtcattcttctgggccagcccccgctgggaggccagtccccggacaccatcggcgtggacggcagggaggttggcaggcttctgggcggggcggcagcgtcccaggcccccagggatgtgccggtctacctcttttgcagggggctggactatggggacagcgcccaggtttatgagggagtcaggaccgtgctggaggagcaggggtatcaatatcggctcattgagagggaaaaccaggacacataccgccaggccatagaggaaacagattctcccggaggcggcaggattaccattatagctctggatgtacaatcactggaccaggccacacggatactggaggaaaacaccatatatcagggcagggtggcagggctctacggcgccggaagcaccacctccctactcagggccctggacaggggaattgtcacgggaatgacagcgtataaccagtttgaccagggatatctgagcgtaaagcaggccgtggaggccatccagggcacgcggcagaagcagcagaccctgctggaggccatttatgtggatgaggacaaattaagggataagacatatgagaaaatgctttatcccattgagtaaaaaagaaaagactgtaaattgggaaaagacgcggtaaggaaaggggcattgcggtgaagcggaattggatgtatctattggcggcctgtatgggggcggccatcctcatagggctgtggcagtacaggggaaacgaaggcggacggcaggcggacaagaattccatccgcatcggggttctgctctaccggggggacgacaccttcatcggtaccctgcgcgcaggcctggaggacaaggcaaaggaatatgaacaggagacaggcatcaaggtaaagctggacatcatggatgccaaggggagccagaatacccagaacagccaggtggagcggctgatttcccttggctgcgatgctctgtgcatcaacagcgtggaccgttcatcggcatccatcatcattgacaaggccatggacgcaggcactccggtggtgttctttaaccgggagccggtggaggaggacatgaaccgatgggaaaagctgtactatgtgggagcggacgccaaggaatcagccgtgctccagggagatatcctggtggatgcataccagaaggattcacgtacactggatgccaatggcaacggtctggtaagctatgtgcttctggaaggggaaaccagccatcaggattccctgattcgcacggagtggtccatccagaccttaaaggacgggaatgtgcctctggagaagattacgggagggattgccaactgggacaggagccaggcgtcggcccttatggaacagtggctgaaggagtatccgggacagattgaactggtggtcagcaacaacgacgacatggccctgggcgccattgacgccatacaccgggccggaatcggggcgaattccatcaaagtagtcggcatagacggcacccctgtgggtatcaaggccctggaggaagggtatctcttcggtaccgtggaatccgataaggagaagtatgcccaggccatatttgacattgcctggagcctgtccctgaaccaggacccaaagtccagggtaccgcagctggaaggaaaatattactggtgtccccagagggcgctgacccaggatgaggcaaaattgcttaaaaaccagtgagtcatatgtaaaacgccgatgaaaaaggataaaatcaaagaaattttataatccttctataaaaatcatatggaaaaatgcacaatcaggtcgtataatgaacttgttgttaagcaaaaacaaccaaagacaacaaaaatataagggaggaattaaaaatgaagaaagcattaagtgttgctcttgcgtgttccatggcattatcactggttgcctgcggaggcggcagcaagccaacagaagcaccaaccacagcagctgcaggggataccacaaccgcagcggcagcagacacaaccgcagctgatacagcagcggcacccgaagcaggcgcagaggtggcaaacaaggataagcctttggtatggtttaaccgtcagccatccagcagtgcaacaggacagcttgatatgacggccctgaatttcaataaggatacatattatgtaggtttcgatgcaaaccagggtgctgagcttcagggaaccatggttaaggattacattgagaagaacattgattcaattgaccgcaacggcgacggaatcatcggctatgttctggcaatcggagacatcggacacaacgactccatcgcacgtacaagaggtatccgtaaggctcttggcacagctgtggagaaagacggcaacatcaacagtgaccctgttggtacaaacgcagacggcacagcaaccgttgtacaggacggctccatcgaagtaggcggaaagacatatgttgtccgcgagctggcttcccaggagatgaagaactctgcaggcgctacatgggatgccgccacagcaggcaatgctatcggcacatggtcttcctctttcggcgaacagattgatatagttgcatccaacaacgacggcatgggcatgtccatgttcaacgcatggtccaaggacaacaaggttcctacatttggctatgatgcaaacagcgacgcagtggctgctatcgcagaaggctacggcggcacaatcagccagcatgcagacgtacaggcatacctgacacttcgtgttctgcgtaatgcactggatggagttgatattgatacaggtatcggcacagcagacgatgcaggcaatgtcctgagccctgatgtatatgtttacaaggcagatgagcgttcctactacgcactgaacgtagctgtaactgctgataactatacagatttcacagattccaccatggtgtacgcacctgtatccaatcagctggatgaggcttcccatgctacaaagaatgtatggctgaacatctacaactcagctgacaacttccttggctccacctatcagcctctgcttcagaaatatgataagcttctcaacctgaaggttgactacatcggcggcgacggacagacagagtccaatattacaaaccgtcttggaaatccaagccagtatgacgcatttgccatcaacatggttaagacagacaatgcagcttcatacacatctctgcttgagcagtaatattcattgaaacaacaaaagtacacgataagaagaatcgtggaaaggtaaagatgtgctgttattagggagaagaaattctccctaatatttaatactgaaacctatcaatctacatatacaggagtaaaataatggcagataagaaagatgatatcgtcttatcaatacgcggtatgagcaagtccttcggccggaacagggttctggaccatatcaacctggatgtgaagcgcggaaccgttatggggcttatgggtgagaacggagctggtaagtcaaccatgatgaagtgccttttcggcacctaccagaaagacgagggaaatatcttcctgaatggcaaggaagtaagcttttccggaccaaaggatgctcttgaaaacggcattgcaatggttcaccaggaattgaatcagtgtctggaacggaatgtaattgataatttgttcctgggacgttatccggttaattccatgggtgtaattgatgaaggcaggatgaaaaaggaagccgccgagctctttagaaaattgggaatgactgtaaaccttacccagcccatgggccgtatgtccgtatcacagaggcagatgtgcgaaatcgccaaggccatctcctataattcaagggtgattgttctggatgagcccacctcctccctgaccgtacaggaggttgacaaactcttcgagatgatgaggatgttaaaggagcagggaattgccctgatttatatttctcacaagatggatgagatttttgaaatctgcgatgagatatccgtgcttcgtgacggaaacctggttatgacaaagagcaccaaggatgcaaatatgaatgagctgattgcagcaatggtcggccgttccctggataaccggttcccgcctgttgacaatacccccggcgacgtgattctgtccatccagaatctgtccacaaagtttgagcctcatttgcaggatgtttcatttgacgtaaaagaaggagagatattcgggctgtacggcctggtaggggcagggcgcacggagcttctggaaaccatctttggtgtccgaaccagagcggcaggacgtgtttattttaataaccgccttatgaatttcagcagcgcaaaggaagccatggagcatggctttgccatgattaccgaggagcgcaaggcaaacggactgtttttaaagggcgaccttacctttaacaccaccattgccaatctgcagcagtatatgtcgggcatagcgctttccgatgcaaagatgataaaggccacgtcaaaggaaatcaaaatcatgcataccaagtgtatggggcctgacgacatgatttccagcctttccggcggcaatcagcagaaggttatctttggaaagtggctggagcgcagtccgcaggtgtttatgatggacgaacccaccagaggaatcgacgtgggcgcaaagtatgaaatatatgagcttatcatcaatatggcgaagcaggggaagacaatcattgttgtttcttctgagatgccggagatactgggaattacaaaccgtattggtgttatgtcaaatggacgcctttctggaattgttaatacaaaagagacaaatcaggaagaacttttaaggctcagtgcaaaatacctataagggggattcatggatatggcgaaaggaaacaatgagactcttacggctgaacaggaaatgcagctgcgccagccaattgaggagtacgttggcgaaattcagaaaaaaatcgacagtctcagagcggacggtacaaacagggtagttgccctgcagaacagtattgacgcaacaaagagagaccgttcccttacaaaggatgaaagggaaaacaggattgcatcatgcagcgcggagatggaaaaagcaaaggctgttgaggcaaagaataaggatgagattgcaaagttaatctccgatgccgagagctacctgaaggcgcattttgataaggaatattatcagcccttaaaggaaagctgcgagcgggaaaaaattcttgcaaaggaaaaatacgacacaaaagttgcacaactgaacaaagaacatgaaaacaccctctcaaagcttacggaccatcaggagataaaggatgagaagtatgttcataagaaccgtctgtttgacgcgaagatggacctggacaaggagcttcagcgaatcaaggacagaaggcatgctgcctttgcatggcagtatcatctgattgatatgctccgcctgtctaaattcaccttcatggaaaccagggcgcagaaatgggagaattataaatatacattcaaccgcaggacattcttactgcagaatggtctgtatatcgctattatcctgattttcatcggactgtgtatcgctgcgccggtgatgaaaaacgtgaagctgcttacctataataatattttaaatattctccagcaggcttccccaagaatgttcctggctctgggcgttgcaggacttatcctccttaccggtacggacctctccatagggcgtatggttggtatgggcatgaccacagcaaccattatcatgcaccagggcatcaacacaggcgctgtgttcggccacgtatttgatttcacaggcatgcccattggcgtaagggttgtatttgcccttgttatgtgtatcattttatgtacctgctttacggccatcggaggtttctttacagctaagtttaagatgcatccatttatttcaaccatggccaacatgctggtgattttcggtcttgtgacctatgcaacaaagggcgtttccttcggcgccattgaaccggccattccaaagatgattattccaaaaataaacgggttcccaaccatcattctctgggcagtggctgccattgtgattgtatggtttatctggaacaagaccaccttcggcaagaacttatacgcagtaggcggcaacccggaagcagcagctgtttctggtatctccgtattctgggtaaccatgggagcattcattctggcaggtatcctttacggattcggttcctggctggaatgcgcaagaatggtaggttccggctccgctgcttacggccagggctgggagatggatgcaattgcagcctgcgtggttggcggcgtatcctttaccggcggtatcggtaagatttcaggtgtagtagtgggcgtgcttattttcaccgtacttatctactcccttaccattctcggtatcgacacaaaccttcagttcgtattcgagggcatcatcatcataaccgcagtaacacttgactgcttgaagtatgtccagaagaagtaattggaaaagataggtgtttccgcccgtatttccaagacgctgaaaaccggctgaatacaagaggctggctgccaaaactcgcagccagccttttcatgtattttagatattgggctcaaacactcttcccctcacggacggatgcacctaacctctccaagcatcccctaaaccccacacgccaacttactattttgatattcccccgtaaacgtaacatccctgccaaaccattccgggggctggaaggacagggcttcttcttcagtgggaaattctacctcggccagaatgaggccggcgtagcggccttcaaagacatccagttcaatggtcagatggcctgggctgtccagggggatgagatagcgttttttggtgagcacaatgccgtcggccttggggagcaggtgggagtaggcttcgcgggtcagcggaaggttgtattcttccctggacagaagacctttgcctttgtaggtgagatagtagtcttcgtcctcctgccggatgcggaccaccgggccggtgcagagataggcttgctcaatctgatggaagggatgggtgtcatagccttccggaagacggggaaccaggaatttacgttcgatttccatatggtaaaacctccttgctgtgattgtcgattagtggattttactaactatttttattttttccattttacaatcatatcatttaactctttccctgaaaagtgataaatgataaaatacaattactatgcgataaatggcggaaagggagattatcatggcaaaggtttatgcatttcttgcggatggactggaagaggttgaatgtcttgcggttgtggacgtgctccggcgttccggtgtggaggtgacactggtgtctgttacagggaacaggaacgtgactggttcccatgggattgagttggggacggacgccctgtttgaggatgtgaacccggatgtggcggatgtgctgttcctgcccggagggatgccgggaacgaacaatctgaaagcgcacaagggcctgggagtggctgtggagtgtgccaacaagcagggcagaaggattgcggccatctgtgcagcgccaagcatcctggggagcatggggctcttaaagggcaggacggccacctgttatccgggatttgaggaccagctcacaggcgtgtcctacaccagccagggtgttgtgacggacggcaacatcaccaccggcaggggcctgggatttgcccttgatatgggactggaactgattcgcctgcttcagggtccccagcaggcccagaagattgcagcggcaatccagtacaactggggataacatccggacgagggaaactcccgttctgttccatatcatgggtatgtgggatggaatggaagttttttttgtaaaaaacgctggtgtttttaaaatgagcatgctataatggtacattgaagtgtagcgccctcatggattatgggcgaaccacatatattttaaggaggaacccgtaaaaatgagtgtacaagtagaaaaattagaaaaaaacatggccaaactgacaatagagttaagcgcagagcagtttgaggatgcaatgaaaaaagccttcaataagagcaagaacaaatttaatattccaggcttccgtaagggcaaagcacctcgcgccatgattgaaaagatgtatggcgaaggcatcttctatgaggaggctgccgatgaagctatcaacgcaacctgcatggaggcaatgaatgaaagcggactggaaatcgtttccagaccagaagttgccgtagagcagattggcaaggacaagccgttcatctatactgcaaccgtagccgtaagaccggaggtgaccctgggcgagtacaagggcattgaggtagagaaggtggacgctgctgttaagccggaggatgtggaagctgaactcaagaaggtgcaggagcagaacgcaagacttctgaccgtagaggacagaccggttgctgacggcgaccagaccgtcatcgacttcgagggatttgttgacggcaagacatttgacggcggcaaggcagctgattaccctctgaccattggttcccattccttcatcgatacatttgaggagcagctggttggcaagaacatcggcgaagagtgcgagattaatgtaaccttcccggaagagtatcatgcagcagagctggctggcaagccggctacctttaaggtgactgtaaaggaaatcaaggtaaaggaacttccggaactggatgatgagtttgcaggagaggtttccgaatttgacactctggatgaatacaagaaggatattgaggcaaagattcttgagagaaagcagaaagaagctgcttccgaaaacgagaaccgtgtggttgacaaggtagtggcaggcgcatccatggagattcctgacaggatggtggaaggccagattgacaacatggttcaggatacagcccgccgtatggagagccagggtctgtctatggacctgtacatgaaatatacaggtatgaccatggagcagatgagagagcagatgaagccgcaggccttaaagagaatccagaccagactggtgcttgaggaagttgtaaaggctgaaaacctgcaggtttccgacgaaagactggatgaggaaattgccaagatggcggccacttaccagatggaggctgacaagttaaaggattatatgtcagaccgtgataaggaccagatgaaggaagatattgctgttcaggaagcggttgatttcctggtagcagaagcaaaactggtataattcacatatgatacggggggttcacagcgcttatttgactggctttgaatctccctggtttcttataagtgaacgtcattccgccgggcgggtgaaagaactggccgggagggatggcatgtattgcgcgcagacgcctgaaaacaggcgccgcgtgctcataactaggaggatggttatatgagtttagtaccttatgtcattgagcagaccagccgcggcgagcgttcgtatgacatttattcaagattgctgaaggagagaatcatattcctgggcgaggatgtaaacgatgtgtccgcaagccttgtggttgcacagcttttgttcctggagtcagaggaccccggcaaggatatccatctgtatatcaacagccctgggggttctgtatccgcgggatttgccatctatgacaccatgaattacatcaagtgcgatgtgtctaccatctgtatcggtatggcggccagcatgggcgcgttccttctttcaggcggagccaagggcaagcgtttcgctctgcccaatgctgaaatcatgatacatcagccttccggcggggccaagggccaggcaacggaaattaaaatcgtggctgagaatatattgaagacaagaaagaaattaaacgaaatcctggcagcaaacacagggaagcccctggaagtaattgagcgcgatacagagcgcgacaattatatgtctgcattggaggccaaggaatacggccttattgatgaaatcatcgcacatcattagtgctgcagcgcagcgctaaggcatcaggccggtaacgtaaaacagcaagtaaaggatatgaaaggttaggtatcgtatgccaatgagaccagatgacacgattcggtgctccttctgcggaaggacacaggatcaggtacggaagatgattgccggggcaggcaacaacaatgtgtatatctgtgacgagtgcatagaattgtgctctgagattctggaagaggagctggagggacaggatgaaggggaaagccctgcactggccgatatacgtctcctgaagccaaaggaaatcaaagcatttttagacgaatatgtcatcggacaggatgacgccaaaaaggtgttgtctgttgcggtttacaatcactataaaagggttacggcatgccagaacatggatgtggatgtgcagaagagcaacatcctcatggtggggcccaccggttcaggtaagacctacctggcccagaccctggctaagattctcaatgttccctttgccattgcagatgcaactgcgctgacagaggcgggatatgtgggcgaggatgtggagaacatcctgttaaagcttatccaggcagctgattatgatatctcccgtgccgaatacggcattatatatattgacgagattgataagattaccaagaagtccgaaaatgtatccatcaccagagatgtttcgggcgagggcgtccagcaggccctgcttaagattctggagggtacggttgccagcgttccgcctcagggaggcaggaaacatccacaccaggagcttcttcagattgataccaccaatatcctgtttatttgcggcggtgcctttgacggcctggagaagatagtggagcagcgcatcagcgcaggttccattggtttcaacgccgaggtggcgagcaagaacgacctgaacatcgatgagctgctcaagaaggtggagccaaaggatttgaccaaattcgggctgattcctgagttcataggccgtgtgccggtgatggtttcactggagcagctgacaaaggaagccatggtgcgcatcctgtcagagccgaaaaacgctttgacgagacagtaccagaagctgtttgaactggacaatgtaaagctggaatttacccaggaggctctggaggaaattgcacagctggcagtagaccgcaagattggcgccaggggactgcgttccatccttgagtcagtgatgatggaccttatgtatgagattccgtccgatgattccatcggaatctgtaccattaccagagacgtagtgagaaaggcaggacagccggaattagtataccgcgacatgcctcctgcatctgcccggaaaccgttgtcagaacggcttagaggggacagcaagacaggagaaattgcgtaggctgtcatgctcctgtgacaatttagaagagagaaagggccgctgcaaatcagatatgacccggaccagaaggcctgttttccggccggtccggcacctgcattgcagcggcttttcaaatggttaagatacaagaggtgaagattgaaaatgggagaacaagtgattacgatgcccgtggtggctctcaggggcctgaccatacttccgggtatggtattgcattttgatataaacaggccgaaatcagtggcagccgtagaacgggccatggtgggtgaccagagactgttccttgtggcccagagacatcctgaaatcgttgagccggagcagggggatttgttccaggtaggcaccatcgccgtggtgaagcagctggtgaagctgccgggaaaggtggtccgcgtgctggtggagggactggagcgggcagaacttctgtgcctggatgccgaggaaccggccatgatgggcgagattgccgccattgaggcggaggaggatgacctggacagcctgacccaggaggccatgctgcgcatcctgaaggacaagctggaggaatatgggagagtcaatcccaagattaccaaggagattctgcccaacctgatgatgattaccgggctgaatgagatgctggaccagattgccatccagctgccatgggattacaccatacgccagaccgtgctggagaacagttccctgtcagccagatacgaggtagtgatgcataccctgctgactgagatggagatatacaggattaaaaaggaattccaggaaaaggtaaaggccgatattgaccagaaccagaaggaatacatcctcagggagcagatgaaggttatccgccaggagctgggcgaggacgctgtatcagatgcggacgaataccagaagagactggacgcactgaaggctgacaaggaagtaaaggaaaagctgcataaggaaattgaacgcttccgcaacatgccggctggaagccaggaggccaatgtactgcgcacctatgtggaaaccttgctggacctgccctggaagaagatgtccaaggacaatgatgacatcaaacatgcagagaagattcttaatgaggaccattatggactggagcaggtaaaggagagaatcctggaatacctggctgtccgcgccctgaccaagaagggcaccagccccatcatatgtctggtgggacctccgggaaccggcaagacatccattgcccggtccgtggcaagggccctgaataagaagtatgtgcgcatcagcctgggcggcgtccgggacgaagcggaaatcagggggcacagaaagacctatgtgggcgccatgccgggccgtatcgtggagggcatgcgtcaggccagcgtgagcaatccgctgatgcttttggatgagattgacaaggtgagcagcgattacaagggcgatacctcctccgcgcttttggaggtgctggacggagaacagaatgtgaaattcagggaccactatgtggagctgcccattgacctgtcccaggtcctgttcattgccacggccaacaccacccagaccataccgggcccgctgctggaccgtatggaactgattgaggtcaacagctacacggaaaatgagaagttccacatagccagggactacctggtggcaaagcagatggagcgcaacggcctgagggacagccagattacattttctgataagagtttggagaaaatcatacacaactataccagggaagcaggggtcaggaacctggagcgccgcatcggggacgtgtgccgcaaggcggccaggcagttcctggaggataagaagaagtccatcaagattacggagagcaacctggagaaataccttggcaaggaaaaggtgacctttgaaaatgccaatgagcaggacgaagtcggtattgtccgcggtctggcctggaccagcgtgggaggcgacacccttcagatagaagtcaatgtgatgccgggcaagggcagccttctgatgaccggacagttaggcgatgtgatgaaggaatccgcccagacagccctgacctatgtgcggtccgtgtgcccccaatatgagattgccgatgattactttgaaaagcacgacctccacatccatatcccggagggagccgtgcccaaggacgggccgtctgcgggaattaccatggccacagccatgctgtccgcagtgacgggcaggagtgtccagtccaaggtggccatgacgggagagataaccctccggggacgggtcctgcccatcggaggactgaaagaaaaaatactggcagccaagatggcccacatagaaaaggtactggtgcctgataagaaccggccggatatggcggagctgtccaaggaaatcaccaagggtctggacatcgtgtatgtaaaggccatggaggacgtggtgtcggaggcgtttgtttagacgcggcatcggagacgtttgtacaagcaacggccaacggataggaattaggagaaggaaatatgattataagagacgtgaatctggagacagtgtgcggcgtgaccagcaagatgccggaaaatatattgcctgagtttgcatttgcaggcaagtccaatgtggggaagtcatccctcatcaatgcgctgatgaaccgcaaggcatatgcaaggacttcctcccagccgggcaagacccagaccatcaatttttacaacatcaacggggcattgtactacgtggacctgccgggttacggctatgccaagatagcggttgaggtcaaggaaaaatggggcaagatgatagaacggtatctcaggaattcccagatgcttaagatggtgttcctgctcattgatatccgccatgaaccctcagccaacgataagatgatgtttgactggattacctacaacggataccatcccgtcatcatcgccaccaagatggacaagattaaccggagccaggtgcaaaagcatgtgaagatggtgcgggaaggcctggggatggaaaaggacggcatcatcattccgttttcggcagagacaaagcagggcagggatgagatatgggaccttattgaggggaatctgtagaagctctgtatgtctcaaatagaacctgaatttataaagtaaaaagggcctgatttcctggcagatgggtattacttgcaggaagtcaggccttttggcgctgattttgtatggttttacagcaagctctgctgggaaggcgtcattggtactgctccttcaccagctcgataaaataccttccgtaggacggaatataccggcccttctgatataccgcatacagcgtggtcacagtggcgggctctcccacggaaaagcacagagggggattgtcaaaatgtattttcctgacataggattcaggggccaggcagagggctgtgccggaggctgccagacgtatggcgatatcgctgttgcgggtaaacaaaaggaccggcgggtttatgccggcctttttaaacagcccggcggatatccggcctgtggtctggtcctgtggatgcaggatataggcttcctgttccgtatgccggatatccatccagggatagcaatacccgtccctgaccactgccttttctgccagaggatgatggggggaggccaccagaacgatttcttcctgtcccaggtactccgctgtctgggcggggtccgtggccgtggaattatagatggcaaagtccacattgggggaaagggccagctgcttttcaacggagtgggattcctccagaagatgaatctgtacatccgggtaccgggaataaaaacgggacagtatatccggcagcaggcaggagccgcgcatcagtgccactgcaatggtcagctgtcccttttcctcccccaataaatcctcgcattctgagttccagtcagaacctatctggaagattttttccgcataatccatataacggttgccgatatgggtggggaccaggtcattgccaatgcggctgaacagaggggagcctatctggcgttctatattctttacggccttgctcagggcagactgtgtaatgaacagggagtctgccgcctttgtgatgcttccatatctgcgtatggccagcatataccgtatttcttttgatatcatctgtacacctccaatgaaaaaaattcataacttggatgattattatgactttgacacctacctatgcacattgtataataaaaatcatatacaatcaagggtttcatcaatattgctgaatggaggcgccatggaaacagagagagcggattttcttgtaagaggggcaaaggtctataacagctactttaaaaagtttgtatcggcagatgtatctgtattgggagggaaattcttatacattgattcccgcaggtcaggcgcagttaaggctgacaggacagtggatgcagagggtatgtacatggtgcccggattgattgacatacatatgcatattgagagttccatgctgacgccgggagcgttttgcaggcggctggcggaatgcggggttacaaccattgtgtcggagccccatgagatggccaatgtgaacgggatgcagggggttctggatatgattcgggcaggggaaaacagcccggttgatattttctacgggattcccagctgcgtgccctccacctcccctgagttagagactaccggaggcatcataacctgtgaggagatggaaggcctgaaggaaaatccctgggtggcctgtgtgggggaggtcatgaactacaggaccgttatccgggaaaaccagctggaaattacccggttccttaaaaagctccgccaacaggaccgcatctttcccattgaagggcattgtccggcgctgctggacctggatttggcaaagttcctgtatcttggcatcaatggggaccatacggagcacagcatggaagaactggaacagaggtttgccaatggcatgtttatggaaatccaggaaaagatgctgcggagagaggttctggactacatcagggaacatggtctggaggaacatttctgctttgtcacagacgatgtcatggcggacaccttttgtacccagggccatctggatgccctggtgcgcagggctgtggagctgggaatgacggcggaacaggcaatctataacgcctcctttaccccggccagacggatgaaccttttggaccggggggcaattgctccgggaaaaacagctgatttcctgctgctcagtgatttggatgggttttctgttgcatctacctataagaacggaaactgtatctggagcaggggacaggtaactgcggaacagacccgggacatgcgttttccggagccctattaccacagtatccggctggattaccaggaacagagccggtttgcggttcccatggagccggattccggcacagtccgggtccgggtcatggagattcaggatggctccaccaggacaacggaaaaaatcctggatatgccggtgaaggacggcatcctccagtgggaaggttcaggctgcctgctggccgcggtattcgagcggtatggcaagggccgggcagttggatacggactgctgaccggcgactgccacaaacggggagccgttgctaccagctatgcacatgactgccacaacgtcctggtggccggcgcgaatcctgcagatatgaagcttgcccttaaccgcgtcatagagatgcagggcggcatggccgtggcggatgcaggaacgatacaggcagagctgcctcttaatgtgggcggtattttatcggaccggccggcaagggaggtgggggaaaagctggccggggtacgcggggcaatggcagaccagggttacagacattacaaccccatcatgtccttctgcaccctgacccttccagccagccctgccttaaagctgaccgataaggggctgattgatgtaaaagcctgtaaaatcgtgccgttgaaaatggaagagtaaatcaaaaggaggattaatcatgtcaaaggaaactgaaggtacagccaagaggggagcttccggcacctggattgacaggcaattccgtctgacagagcatgggaccacggtgcgtacggagattctggccggtatcaccacatttgttaccatggcatatgtgctgggaacagtccccaatatcatggccaatgcagggcttgacagaggggtcatgctcacatccatgattttgctgattattgtcaccacagtggccatggccctggtgacaaaccgcccgtttgccctggcccccgggctgggcagtgtggcaatcgtgtcgggaatgattgccaacagcgggatttcgcctgaaattacggcgggtgtaattttctggagcggtgttatttttattgtgatttcctatatcggtctcagggatgctgttgtaaatgccattcccgccagcctgaaacatgcagtcagcgcaggcgtgggcctgttcatcgctttgctgggatgtaagaatgcaggactgattgttgccctggaaggcaagaataacctggccttcggagacttaagttctgcttccgtgcttctggcgctcattggattcctgctgattcttatcaccaagcagatgagggtgccgggatacatgattttttccattctgattaccactctggccggtatccccatgggcctgactaagatgcccgaggcatttttcatggcgcccagctctccctttggccagttcatgaagattgatttcctgggagcactgcagtttgcctatctgccgtttttgattgccatgtttgtgccggatttcttctctaccttcggcacagccctgggcgtgggcgcaaaggccgggttcctggacaaggacggcaaccttccgggcatagacaaggtgtttaaggtggatgccattgcaaccgctctgggcagcctgttctgtatgccgtgtatgactacctatctggaatcctcctccggcgtggaggcaggagggaagaccggactgacacccatttccacaagtgtctgttttgcctttacccttctgctgacgccgtttgcgctgatgattccgtcggctgcaacggctccggcccttattatcatcggagtgggcatgctcaattccatgcgcaacatcaactatgatgattttacggaatccttcccggcatttatctgtgttgcatttaccatatttgcaaataatattgccaatggaatctgcgtggccctgccggtttatgtggtcctgaagctggcctccggcaagattaaggaaatgcctaaaatcatgtatgtgctgctgggagtatgcgtgctgtatttttacagtatcattaaatagcagcagagagccgctgggtcctttacgccattctgcacggatgctttttgcaggtggccaggctcactgccaccagcaggatgccgcagacaacggcgccgggaacggtttcccccagtccccagggattgccggccagtttccagcccacacataccgcgaagccgcccgtcatggcagatatgatgccctgactggtggcttttttccagtacagggccgccagggagggaagacctgctgcggcagcatagaaggaccaggcaaacatgagcacattgtaggcgttcttgatgtaaagggcaataatcagggcgcccatggccaggaccacggacatgacgcgggacatgagaatttcatgtttctccgtcatttccggcatgaaattttttccaaggtcgtgtacaaaggtctggacagataccagcagatagctgtccgcagtggacatcatgaccgacaggatgcctgccagggccagtcccgtaaggccgggaggcagaatgcttacagccagggccggtacaacggcatcagagcttccgtaggaggccaccacatccggcagaatctgccttcctgccagtcccatgaagaataccagggcaatggttatcatgtaaatggaagtgccccagaacataccctgggtggccgccttcttactcttggctgcaaaggccctctgccacatctcggcccctgccagggtgaacaccagataggtgacaatatcgcccagaatgctgccgttgatatgagggaccaggtaggatttgtccaggttctgccagaaggaggaaaagcctcccaggtaccgcaggctggaaaagggaatcaggatgtagacaaagataatcagcatgaagaactgaagcacatccgtgtacaccactccgaaaaggccggatgcagcggtgtagatgatgaagataagagtggctgcaagggcgccggcttcatagctgatgccgaattcatttcccagcattttgatgatggtggcggtggcggttacctgggcagctaccgtgcccatcatggtgaatacaatcatgaaggccaggatgcagcgggcggtccggttgaaccggtagtgaaaaagctccggtatggaattgatgtttctggtgaagccaacctcctggatacgtccggcgatggctgagaagatgaacatgccgatgagataggggatggcggtcatgaccgccttaaagccagtggtgtaggcaatgcctgcccgtcccatcatggcgctgccgccgatgatggaggcgcatacagtggcagtcagcacaaaggggccaagggttctgcctgcaacgtagtaatcgcctgtattcttgattcgtttgacgaaccatacgcccacaaaaagcattcctatcatatagaggacaatgatggccagatccaggttagtgagttcatgcatatatcaggtctcctttcgttggggcgccgccttgggagggtgcggtgatggggaatatccttggatgtattcagttttaggtaaaggaaaagaacggacttaacaaaagaaaccgtctgcatggatgcagacggaaaagtatacgacaatacagcaaaatgatttaccagaatgtccctgtccctcttccgcctatgagattagctgccgggttcgggaaagaaaggttccctatcatccggggccgtaacaggccgggcggatgaatacaccccaaaaaatcggttctcccactgctacatagtagcattaagcgacttggtataatattaacactatcttaacattaaatatatcacagaatggggagcgtgtaaagaaatatgcagaaaaatgccttttattggcacaacaccgggcaaaagcctcagattcaactcgacatatccggcatttagcgtataatatataaaggtatgaatgaaaaataagacagagggcggaatggaaatccagaggcgcccggctgtatctggaggtattatgtaatggaaacgggaccaatacgggtggcggtcatggcggacacccatggagtgctccggccggaggtggagaggattcttgaaacctgcgatgtgattgtccatgcaggggattttgacaatcagatgctgtatcacaagctgaatgtggaccagcccttgtatgcggtaagggggaataatgacagaggatggtcagggggccttggccaggtaaaccggtttgaaatcggcggggtaaaattcatcatggcccacgaacgtgtggatattcccagcatgcttaaagatatacaggtagttatattcggccattcccatatgtactatcagcaggaaatcagcggaaggctttggctgaatccgggaagctgcggttataagcgttttaccctgcccctttccatggcagtgatgaccattgaggacgggaaatatgaggtggagactatctggctggagcatggatacggcacgcccggagcagccaccggccagagagagaagaccagggccagcaagtatgaaaaacagcagaagcgctataaacagaaggcgggaaagacagccggccagagcggaacttccgggggagcagaacaggcggaaggggccgggggagcgccaaaggcagccaggtacggcggacatccggcggccaaacccgaggcacccaaggcggaagcccgtatggtgaccggtccggagcaggagaaggagtatctgttcctgatagcgaaaatactgcgtctgagaaaagcaggtgaatccagggaatgggtcatccggaatctgggagagaatttcaggctggccgcaaccatctacgacatatgcgaaaaaaagccggactcaaacgcccggcagattttggaactgttattggaacaactttcgttttaaccggtacaggaaatggactgataggaaaggcatggataaaagtcaggataaaagtgaccgcatgacgtgggcatagatttcctggctttttgttttccatgtattgcacatggattctgcctgctccctgtcgggaacagacaaatccagccgaatcagggttgttttgttctcacggacctcacagtggacaatgtagtcctggttggtccccttgtagaagtcggccgtggtgcccacctcctcccggagacggaacttgttttccttaaggtaatggtccatgtcctcaatgatggcggaggatatgttcttgccgaagaagttaagggtttcctcgccctccctggtgatgtcataccgggtgctgttgtggctggcctccttgtgcaccaggccggcgtcttccagctcgtttaaggcctgctggagggtaaagtaggtggtgtattcatgctctgtgaaaaagttggtgagctgggcgttggtcaggggaaagttcacctgcttcagcatatagagattcatcagtttgtacaaggtcataggttcagtcagcatatcatacacactccatcagggttttcttattattttctaatgtggtcctttaccgcgctgctgaccacgtctgccacgcgggggtcaaaggcttcgggaagtatgttctcgtcgcttaaatccgcttcatccaccagtccggctatggcctcggcggcagccagcttcatctcctcggtgatggcggcagcacggccttccagagcgcccttaaagattccggggaataccactacgttgtttacctggttggggaagtcggaacggccggttccaaccacccgcgccccggcagcctttgccaggtcaggcatgatttccggaacagggtttgccatggcaaagagaatggcgtccttattcatggaggcaaccatgtcctgggtcacgattccgggagcggacacgcccacaaagatgtcagcgcccctcatggcgtctgccagggtacctgttttatattccaggttggttacatccatcattttttcctgcatccagttaaggccgtctgctcccttggtcagtatgccgctcttatcgcacatggtgacatgggcaaatccataggtcagcagcagctttgtgatggcaacgccggctgaaccggctccgtttactaccacgcagcagtcctccttctttttgccggtcagcttcagggagttgatgacaccggccaggaccacgatggcagtgccgtgctggtcgtcatggaatacagggatgttcagcctctcttttaatgcttcctctatctcaaaacatctgggggcggagatgtcctccaggttgatgccgccaaaggcaggggcaatgcgcacaacggtctcaatgatttcctgggtgtcctgggtgtccaggcagatggggaatgcgttgacgccgccgaattccttaaagagcacagccttgccctccatgaccggcatggctgccaggggacctatattgcccaggcccagtacggcgcttccgtcggagacaacggcaatggcgttggatttgatggtgtaccggtaagctgcctccgggtcttttgcaatcaccctgcagggttcggcaacccccggggtataggcaagagccaggtcctccctggatgccacctttgcctttgatgtggtttcaagttttcccttccattcctcatggagcagcagtgctttttcattggttgtcataatccattccgtccttttccttatataatagaaacacaaaaatgcatttttatatatcataacaattttgtcagtgtttatcaagttccttttgaaattaggggaggccgggaccgggggaggggagcacagagtatggatggaaaaacatggaacccgtggtttgcacaaaagatgcaattaaaacttttaaaaccacccaaaatgtgatatcatgttacgtaagtgtggacactttacacagaaggataaagatacaggtggtactatgagggaacgtattaaccgtctggccaggggaatcattgacaatggttcgccggagctggtgctgacgccggagagggtggaggtttcggttcctgcgggtgaggtcatccgtggcgagatattggtgagcagcggcaataacctgcatataaaagggctggtgtattccagccatgaaagggtccgggtagtgaacagcgcttttggcggacttcgcaaccggattatatatgaagtcaacgtgggcttttcagagcacggggacgaaatcaagggatctttttacctggtcaccaatggaggtgagagggagattccttattctttgcgtgtacaggccggtgattcaggggaggttctgggaaatttaaagactcccagggactttgccctgctggctaagaaggaccaggaaaaggcgctgagaatgtttgaataccaggactttacagaagcccccttcatgcaggattcccgggtccgtaccatctatgacgggttgaagggaagggcgggcaggcggaacctgatggaggaattcctggtggccctgcaggtgaaggaaccggtaaagctggggctggaaaccggaaccaggatatatgagaacttaaccggaacagcagaggattatattgatatagcagcaggaacctgggggtatgtgtcggcggacataaccgcggatgcccctttcattgaactggggaccgccaggattacggaccaggattttgtccagggccggtgcagggtgggataccgcattgttccgtccaggcttcacaggggaaggaattttggatgcatccgcgtcaaatccctgggggaggaattcctgattactgtggaggctgagggccgccgcgcagcagggagcactgagcgggaatccggcacagaccggtttatggaccatggaagtctgtataaatatttatccctgcgcctggactatgaggcgggagtttatgagccggcccttctcctgaaccagatgatgaaggaaacggagcatctcagggcggattttccgggggatgagagggccaagctgatacaggcggagcttcttatactaaacggcagggaggacaatgcctccctggccctggacgatgcaagggaccatgtgctggcccacagggagcagcaggtggaattatactgtttctaccagtttctgcgtctggaaatcaagccttctgtccagcagaaggaatccctggtacgctatatcagaaagctgttgtgggaggacggggagatacggccctatcttttcctgatgctgatgaagctggatgaaaccatggcccagaatcccctggagctgtaccggtccatggcatccctgttcaaccagggctgcagcagcccctttctctatgcctctgcctgccgtctgatggaagcccatccggatttgtttgtgcgcctgggtgattttgagatacaggccctgtacatgggggtgcagaaaggaattgtcagccgtttaaccgcactgagggcggcagagctggctctggggcttaagcattacaggaaactggtggagcgcttatttgagaagctgtaccagacatacgaggagctgccaatcctggaggctgtgtgcagcctgctcatcaagggagactgcaaggaaaaggacgcctttgtctggtatgagaaggccctggaacagggagtgaacctgaccaggctctacgagtatttcctttacgccctgccggaggattacggccacctgctgcctaaggaggtgctgctgtatttctcctatgataaggatttggacaggcacagccgtcaggtgctctaccggaatatattggagtatatgaatccctccgcggagctgtatcagaattacaccaggcatatggagcagtttgccatggaacagctgttccagtctagaatcaaccgttccatggccgttatttacgaacacatgatttataaggatatgatagacagccgggtggccagagtgcttccgggcatccttaaatcctgccgcatccggtgcggggattccaggatgaagtatgtcattgtccgctatgaggagctggaggacgaggaggcatttctcctggaaaaccagtctgcttacgtgcctttgttttccgaccgcagtgttctcctgttccaggatgcatacggcaaccggtatctggatgtaaaacactggaaggtatctgtgatggaccggccggagctgctggcccagtgttatgaggtgtatccggaccatcccatgctcaagctctctgaatgcagggatatagtgaaccgcggggtggagacggacgagcaggctgcattgctggaagaaatcgtggtgcagatgcatttaagccctgttttcgagggaaagctgatgcaggcagtgacggattattactgccggaaagcgtctgaggacaaggatggtgacggtgtatttaactgcgcctatctggtgcagattgataaaaagcccatggctgccagacagaggcagcagatttgcgagacattaatcagccagaattatatgcgggaagcctatagcatgattcgggattacggaagccagtatatatctacgccgcggctgatgaagctgtgcaccaagaccatactgatgaatctgtttgaccaggacgacctgcttctggggctgtcccatcaggtgttcaggcaggggtgctatgacagcgtgattctggactatctgtgcgagcattttaacggaaccgtatcccagatgtacgaggtgctgattcagggcgtcagggagcatgtggagacatatgacctggaggaacggctgctggggcagatgctgtttaccgggtgctgcgaccagatggattccgtgtttgaactttatatgaagcgcaagaccaccaaggaaatggtggtaaaggcgtattttacccagaagagcgtccagtacttcctggaagaaaaggatatggaccagagggtgtttgaatatctgaagcaggccgtgagcaatacctttgataaggacaggatgcccactatctatctgctggccctgacgcggtatttttccactctggacaaggtggatgagggggatgcggagcttcttaagaccatgacgtccctgcttttggaggaaggactggtattcccctataccagggagctgtcaaagcatattccggtgccggaggacatcatggataaggccatggtggaataccggggcaggaaggacgcccatccggagcttcaggtgagaatcctgccggaggaaaccggattccacagcgaggatatccgccgtgtttaccaggggatttttgtgaaacaaaaggtactctttgagggagaaatcatggagtacaggatatatgactatctggacggacaccgcaggcttgcggcagagggacaggtggagtgcgaccataagctggagggaaaggagaacagccgttttgcctgcctgaacgagatgggagcagcaatcaaagacagggacgacagcaggcttttaaacgcaatggaagactatcttaagaagtcggcggcgcttggcaggctgtttcccatggagtaatggaggagctgtctatggacggtctagtgattggtctggatttaaatgacgactatacccagatatgctgttatgataaagaaaagtcgtggaccattcctacggtcatctgccggaggaaggaagaggaggtctggctctcaggtgaggaggcttatgcggccaccctgctgggagagggcgttatcgtggataagcttcttaaaatggcggccaaggatggcacatccaccatcggaggcatctgctacagcggcggtacgctgctcaagctgttcatagagaggatgttagggtatcccaggaaggaattcggaacagaggaggtggcgcagctggtcatcacccttcagagcgtggacggcaggctgcttgacaccctgatgtactgcgccgattacctggagattccaagggaccgtgtccatgttatcagccacaccgagggcttcatatactatgtactgagccagaaaaaggagctgtggaccaaccaggtgggactgtttgagctgtccggcgaacgcctgtgttattatgagatgaaggtccagagaggtatgaggcgcaacatggtccaggcagaggcccagaaccaggaggaggcctttaacctggatatcctggactctccctccggcagccgcctggctgataagatacttacggcctgcggcgagaagctgttaaacaggaagctgttttccacggtgtttctgacgggaaagggatttgagcgccaggactgggccagcggcttcatgcggctaatctgcaaccggagaaaggtatttgtggagccctgtctctttgccaggggcgctgcttacaagggagctgattacacccatcaggaaacctcttacccctatgtgttcatctgtgagggaaggcttaaggcggaggtatccttaaaggttatacgcagagggagagagaaccagctggtggtggcctcctacggcgacaactggtatgaatccaaaagctccatggatttgattgtggacggacaaaaggagattgagtttacggtcagtcccctggactccaagaagaaaaagctggtcaggattcctctgaccggatttccggagcgcccccccaggaccacccgggttgagcttaaggtggcctttaccgatgaaggcaccatgacaatgtccatccgtgacaagggattcggggaactgttcccctcctcgggcgcggtggtgaaacaagaggtgaatttatgagcctgatactttgcaggcaggaacctgtgaaacatccctattatatcgatgtgctgggaatccatatccactcctcccaggagctgtgctatgtggtatacaaccacccggtgctggtgatggatgatttcctggatgacctgctgattgatttcatccgcagggatttggacatggattatctggcgggacgcatggagaagctggtggagaccggcgccaggccggaggaggtcctggctctgttcctgtcggaatgtgattattacagcgataaggaaatacagaaattcaagcagacaacagcgtccctgcgggccctgcatccggcccagtatgaaaaacagagggcggattacatgttcgtccagcaccagtatggcaaggctgctgccaggtatgggaaaatcctggagtatcccagggacaaggtggtggaggatttgttcctggcaaaggtgtacaacaacctgggcgcctgctacgccatgatgttccagttccacaaagccctgggatgctatgacaagtcttttgagctggggaaggatgacggggtgctgaaacgcatttattttctcactgtatttgcgccggagctggatgtgaaggacaagtaccagtccgtgtttacggacgagcggaagaggaagtggagcgaggagattgacctggctgcgctggaagcaggccaggcagaggaagtcagggccctgcgtgcattgtttaaaaaggatcccatcaaacggatgagcggcgcgtcggagatggtgcgcaggtggaagcaggaataccggatgatggtctgagcctatatggcgtgaagcggtgcaaagacaagaacaggataaatacgagatgagaacaggataagagcggaggtattacatcatggcgtttgacatagcaaaggagcatttgaggaaggctggcctggaggaccggatttatgagtttgaggtatccagcgcaaccgtggagctggcagcccaggcagtgggatgtgaaccggcccgtattgccaagacattatcgtttttggtggaccggaaggcggtgctgattgtggctgccggggatgccaaggtagacaaccataagtataaggaacaatttaagacaaaggccaagatgctgtctccggatgaggtgacggagatggtggggcacagcgtgggcggggtgtgccccttcggagtgaaggagggtgtggaggtatacctggatgagtcccttaaacggtttgatgtggtgtacccggcctgcggcagcgccagcagcgcagtgaagcttaccattccggagctggagacagcttccgggtatctggggtggattgatgtctgtaaagggtggggggaagatagtatatagttgtattttgtttggaaagctgattctggttatctggaatcggctttttcttttatttcagccatggcgtatgaggggatgcttccgggcaattaattttttcatcattatatttcataaaaaccctggttttgaaaaataatagaaaaaaacggaggtgtcaatggatatggcatgtgtgacagaacaatttttgggttttctgaaggaagaagaaaagtctgatgctacaatcagcaaatatgtttatgaactgcagatgttcctgcaattcttagggaaaaaggaaataggaaaggagctgctgattcagtaccgcagccatctcagcagcctgtaccgtccccagaccgtcaacggtaaattgtcggcagtaaatgcatacctcaggtttatggggctgggtgagtaccgtgtaaagtttctgaaggtccagagaagggcttatattgacgagaaacgggaactgacggaaaaggagtatgagcggctgatggatacagccgggaggcagggaaattaccagctgtattatctcatgatgacaatctgcagtacgggcatcagggtgagcgaattaagatatgtaaccgtggagtccgttatggagggaaaggcggaaatcagcatgaagggaaagtacaggattgtgatttttccaaagaatctggcggcggagctgaaggcctttgccagaaagaacggcatccgcagcggcagcatcttctgcaccagaaccggacgcccactggacagaagcaacatctgccacgccatgaaaaagctctgcatgaaggcaggcgtcatgcgggataaagtatttccccataatttccgccatctgtttgccagaagcttttatgcggtggagaagaatatggcccatctggcggatatattaggccattcctccattgaaaccacccgcatttatgtggctgccagcgtaaaggagcatgagcgggtacttaacaggctgaaaatcggggtaataaaaaaaataccacagaataatcattccgtggtacaaaggtctctgatgataaatcacaggtctaaaaactctatacagtatatctaaaaaaacagtgatagtcaatatacatattgatgttttttcttcaatgcacataagccggaaacaaaatcaagggttgccggcttctttgcgtatctatatttaactttcattttatggtcacggattaaataaaacaaaatattaactgttttatcagatatttaccacagaatgattattctgtggtatctggggaaccggctgaatgaagcatatcatgaagcgcgggatggggaaggaacagggaagttcttcagttgaaaacataataaaagacaataaaaattcagtgaagaatttgatagtaaatcatcatacgaatctgggggggggggtgaaaagcctccctgtttcgtatgcaagagaggagccgcgttggcagagagaaaagaaacgggtgaaaccaaaggctgggtagacatccatgcccatatactgcctggcgtggatgacggggcttctgactgggaggaagcaggggaaatgttgaacctggcccatgaacagggaatcacccatatcattgcaacgccccactatatttccgggcaggacataggcagactgaaggagctggcaaaacagctgggggaggcagcgcattccctgtcggaaaggatgaccattggattgggacaggaagtacagtactttgaggaactgcccttatttctggaacggggagaggtgctgaccctttccagaagccggtatgtgctggtggaatttctgccgggtgacggatatacgcggctgttcagggcggtccgcagcttggttcaggcttcctacctgccggttattgcccatgcggaacggtatggctgcctcagggagagggggaggacagaggagctggttaagtgcggcgcatacctgcagatgaatgcgggaagtcttggcggaggaatttttgacaggcagtctgtctggtgcagaaaggagatacggaagggaaacatccattttatagctacggacatgcatggggtattgatacgtccgcctgagatgagggaggctgccggatggatgatgcagcaggaacggaaagggcagggcgccggggggatggcggagcggcttctcagacagaaccaggaatatatattgagggattctgttttgtaaatgtatttgcctgggaaacaaaataaaggaaatgtgaggaagatggaaaagctgtacagagaagatgatatggagatagacctcctggagttgttgtttgaatttaagaaaagggcctggataatcattctggcagcagtcataggctgtctgggcgcaggagcctacagccgcctgatattgacgcctgtatacacatccacggccatggtatatgtcctctcaaaagagactaccctgacgtccctggcggatttacagataggaagccagcttacaaaggattacagtgtgatgattaccagcaggccggtgctggaacgggtgattgagaaacaggggctgaatatgacttacggccagttaaaagccaggatacggatatcgaatccagcggataccaggatactgaacatgactgtatccgatacggacccggtgagagccaaggccattgtggatgaggtggccaatgcttcctctgattacataggggatatcatggagatggtaccgcccaagattattgaacagggagtggtgccggagaatcctgcatctcccagcataagaaagaacgcggtgctgggcgggctggcatgtatcgttgccgcctgcggcatcataaccctgaaggttattatgaacgacacaatccgctcggaggaggatgtgggaaaatacctgggtatgagcgtactggcatctgttccggatgacgatggtatgtcaaaagaacagcagcgaaaccggagcaagaggaagcaggaccgtaaaaaacgtaaaacagggaaaaacagaaagggggaataggaatggatggagtcttacatctgaaaaataccggcagaaaggattatttttacgaggaagccatcaagaccctgcgcacaaacatccagttttgcggaagcggcctcaagaccatcatgtttaccagttctatgcccgacgaaggaaagagtgagacagcattcgccctggcctcctcctttggaaacataggaaagaaggtcctgctggtggatgccgacatacgcaagtccgtcatggtcaagcggtatgaaatcaatggaaatcccaacggcctgtcccagtatctcagcgggcaaaaaaccctggaggagatatgctatgagacagatatggagaacctgaatatgattctttccggtcccttttcacccaatccggccgaactgctggaggatgacctgtttaagacaatgattgacaaagtgaaggaaacctatgattacattatcattgacactccgccaatggcaaacatcatagacggagccatcgttgccagccaatgcgacggcgctgtcattgtcattgaaagcggggcaatcagctaccgtcttgtacagaaagtgagggggcagctggaaaaaagcggatgccgtattctgggagccgtgctgaaccgggtgggcggcgggtatgagcacagctactatgagagatattacggaaaacgcagcggtaagtattatgggaaatacggcaggcactacggcaggtatgaggagggaaaagcgccgtctgccaatgaagtaagcggggcgcggacaaagaatgacacaacaccgcaatcacaggacacatgacagtcatggaatccgtaaaaacaaccggttttatacccacaggaaacggctgctggcagctgcggccctggctctcatactggcagcactgttcctttataaaaccgctcagatgtatctggaaagaaaggcattgtcccgtgaggcgcagcagtggcaccgcccgcaggcagataacaccatggcagacccggacggcgcagtggaataccgggggaagaggtaccggcgcaatacatacataaaggcaattctgtgcatgggcatagacaggcctggaagtctggaggagaccagggtggctggttccggcggacaggcggacggtatatttctggtggcccaggatacggccagggaccggataaagatgcttgtaattcccagggataccatgacggaaattacattgacggatttaagcgggaacgagctgggcaagggaatccagcatcttacattggcttatgcatatggggatggaagggaaaaaagctgtatgtacgtgacggaagcagtgagccgtctgctgggaggtttatccatagacggatacatggcagtaagcatggctgttctgcctgtggccaatgataaggtgggaggcgttgccgtcaccattaaagagcagggactggaacaggtaaatcctgcttttatccagggcaggaccgttaccctgcgtggagaacaggcagaggcgtatgtgcgctacagggatacaggcaaggcccagagcgctctggtccgaatggaacgccagaaattatatatcaggggattcctggatgcggcaaggaataaatcaaggcttgacgacagccttattccggatttgatgagggaaatagaaccgtatatggtaacggacatgacaaaagaccggtatctggatatggccctggcctttttagggggaaatcaggattttacagatacagatatggttactctgccgggaacagccgtggagacagttgtttacgacgaatatcatccgaatcaggaggaaatcatggcaatcgtactggattggttctacaggccctgggaatgaaggcaggaaatgaacggggcagggaaggaaaaataataaactggtaaagaagcaatctcccttagatggaaaagaaaggtggaaattatgagaaaaagaacagcaatcatgacactggcaatggtccttaccgtgtctcaggccacatgtatattcgcggccaacagcccgggaacagggccggttattgtgggaggcggaagcgacggaagcagctatgacatcggggaaaaggtggaccaaataaaaggaggggcatcctcgaattccacggttacaagttccgggcagggaaacaatgcagtggggatagcagtgggacagacagcgggagaacatgcggtgggaaccaacagcagggggcaggcagtgataggggatactgccctggaatttgtgcagggcaccgacgctgcggtggcaggcttgcctgaaccggtggtaaataccatcaacagcataaacaacgggaaaccgttaaacgaagcagtgccgggattggacctggcgggctataacgccctggttggaacacatgcaatcgtgataaaggacgcagccaccaacacagagaagacagggcaggtggaggtcccgctctatgtgccaaacctgctggacggtctgggcgacgttgaagtgttattttacaacaatatgacaggaacatggcagctcatcaaacccaccagggtggatgcgggggccaagatgctttggtttaatgtacccggctccggtaccttgtctgttgtatataagaaatagagggatggatgaatgtccggttaatatacagtgaaagcacagataacagggaagagtgggaatgtgagaaatagggacagaattgtgttggataaataccttccccgcagtaagcgggtaaggatgtgcctgctctgggcgtatgacatggcggcagtatggatttgcgcctgtctggccctggggcttaggtttgatttggatttttacagtatacctgcagcgtatgtacaggccttacggatatatgggttgctgcagatggcggtggttaccctggtattttatggcggacgcctgtatgccatcatgtggggctctgcgggaacccgggagatgctggaagtggttctaatctgtagcattgcagcgctggcccagcccgcgggtatattgatatccgggcagcggatgcccagaagctattatctcctgtggtttatcctgatggcaggagcggctatatgcggccgcgtcagctttcaggtcctccagaggactgtgaacagattgaaccgcgcctggaaaaaagagtccgcgccccaggtgatggtggtaggagcaggccaggcgggaaccctcattatccgggaaatgaaggccagcgggaaaatccacggcttcccggcgtgcatcgtggacgacgacagggacaagcagggaaggttcgtagacggtgtcatggtagccggtacaaggaacgacataccggagcttgtgaaacaaaagaatattgacgccatatatgtggcgctgccctcagcgccgggggatgagataaaggacattctgggcatatgccagcaaacaggatgccaggttaagtatctgcccggtgtatatcagctgatgaatggtgaggtaaatatatccagacttaaaaaggtggaaatagaggatttgctgggaagggaaccggtgcaggtctgtctggacgaaatcatgggttatgtgcgcggtaaggtggtccttgtcacaggcgggggaggttccataggaagcgagctgtgcaggcagctggcaggccatggggtccggcagctcattatatttgatatgtatgagaacaatgcctatgaaatccagcaggagctgaaacggaatgttccggacctggacctggtggtgctcatcggctccgtccgcaacaccaaccgcatggattacctgtttcgcacgtacaggccggatattgtttaccacgcagcggcccataagcatgtgcccctgatggaggacagccccaacgaagccatcaagaacaatgtgctgggaacctataagactgccagggcagccatgcagtacggcgccagccgtttcatcctgatatccacggataaggcggtgaaccccaccaatattatgggggccagcaagcgcctctgcgagatggtcatacagatgtgcaaccaaaagagcggcactgagtttgtggcggtccgctttggaaatgtgctgggcagcaatggaagcgtgattcccctgtttaagaaacagatagaaaacggggggcctgtgaccgtaacccatagggatatcatacggtattttatgaccatacccgaggccgtaagcctggtgctgcaggccggcgcctatgccatgggaggggaaatatttgtgctgaacatggggaaaccggtgcgaatcctggatatggccgagaacctaatccggctgtcggggtatgaaccctacagggacatcgacatccggtttacagggctgagaccgggagaaaagctttacgaggagcttctcatggatgaggagggacttcagaggaccggaaatgaaaggatttttataggaaagcccattgagatgaattacgaacggtttgagaagggactggcgcgcctggatgaggccgcatggctggagaaggacaatatccgggagctggtccacgagatggtgccggagtaccattacagggcgcaagaggatgccaatggggcaatgacagaccaggacgaggttttggcacaggccgccgccggtatggagcctggctgtggggaaggagccggaccggaaccgggggatggtataatgcctggggtgaaatctccggcaaggagcaggagagagcttcataatgcaatggcagtatacaacacattacaggatgcaacaatgacaaaatagggaaataccattatttagtttcctgaaacaaatcacgcaaaggagggtgccggtgtgccggaaaagcccaaagtatacatacagacattttatggtttcgatgtttttgttaacggcagcgtaatctattttccaagcaaaaaatccaaggaacttttggccatccttgtgaaccaaaggggaggaagcgtgtcgttggcgcaggcggtacatattttatatggaaatattaaggaaagcacggccaagaaaaatatcagggtggtgtatcatcggctgcgaaggacgctggaggaatatggatgtgaagaaatgctgattcataaaagaggcatattttccattcatacagaatggtttgaatgtgatttgtacgagttcgtgaagggaaatgaagcctatctgaccgcctatacaggaacctatatggcggaatatccctgggcctctgccaccataccatatctggatacgatgtatgccaggataaatgataatgataaaacccgtagggtagtttacagcgaggaatcgagcggatgaagatgaatacacggatgcaggtgaaaactctgatgcatataaaaaccctgatacagatgattatatgcatatgggcagcccttgtcatatccgtcatacccgtatatggggcggacggatggcagcaggataccgcactgcaatggatttatatggagcatgataagaaggtggtaaaccggtgggttacctgggaggacggcactcccaggtatctgggcggcaatggtctgattgtcaccaacaactgggtgaatgtggagggggagcgttaccgcataaaggaggacggttcccgctatgaaaatggatggttcagcgtcacatccaatccaagcctgccttctggaaagccttccacggcctggtattatgccggggctgacgggaaaatcctggttaacggctggcatgagctgggaggaaggtattattacttctatccgggaggcaattcacccagaaaggctttttttacagcagaggataagcggtattacgtggatgaggagggagccagaccggagccgggctggttttccactgagaacgtggacagcaaagggaatccctatgtgaactggtattatatccagccggatggttcccttgtgacggacggatggcatgagctggacggcataacctactattttgacaaaaacggcaattcccccaggaaacgctgggtcaacatagaggacaaccgttactatgtggacggcacaggggagcttatgaagggctggttttccatcaccggaacatcctccaacggccaggaatacaccaattggtactatggagattcaaacggcgtactgtggcgtggaggatggggagccatcgacggaaaatggtattactttgacccaaacggcctgaattacaggaagcgctggtatatagacaacgtcaagggtgaccggtattacctggatgaagacggcgtgcttcaggataagggatggttcaagattgataatgtcaacagtgttaccaaggcagtgacagagaactggtattatgccggggaaaacggggcggtgttaaagggcggatataagacaattgggaatagggaagcagagaatacggcggcagcggaaaggacttattatttcgatgcaaacgggctgaactaccggaaacgctggataacggataataacggtgacaagcgttatatgggtgatgacggggccatgaagaaaaaagaatggtttgtcatcagcggcctggactccaggaatgcggattataataactggtactatgcggagcgtgacggaaaggtcatcgtagataagtggcataagattgacgggaagtactactgctttaacgcctccggcgttatgcgcaagggctggcttacagagactccggaggatgacgacaaggagagctcctattactactgcgcagaagacggagccagggcaacgggatggcaatggctggagataccggaaagctggatggataataccgatgtggcggattatgtacaggaacacggacagtatgcttacttttacttcagtacgtcctcgggaaagaagaaacggtccgaaggcggtaggcaggaaaaggatgtggacggcatcacctattgttttgacagctacggcatcatgtatcccgggtgggtaaaaatgagcagtactgtgcctgaaatcaagggataccgttatttctaccagccggaaacagaaaaggataagaagtatattcccggagaaaaggtggaaagcgcctggctgaagttagagggccctccggacgccagcggttcaggccagaaggagtggtattacttcgataatacaggaaagccggtgtgcggcggcgaggacagctatgagataaagaaaatcggcgacgggtattacattttcgatatgttcggtgcagcacagttcggtctggttgaggtaaagggcgacttttattactgcggcacagaggatggggacaggaaatgcatggtggggaaagccatggtggatgacggcgtcagcgccacccgttcacagtattattttgatatcaagggcaagggtatcacaggtatcaaggacggttatgcatactataaggggaagatgcaaaaggcagataaggctgcccgctatgaggtgttcgatattccgggggaagggaaatgcctggtgaacgcatccgggaaggtgatgaagaatacaaaggtgactgacggcaacggccagaaatgggagaccggggccggcgggagtattaaggtttacgggtcggatgaggttgcggagctggaggtgccggaggctacggtgtcgtattagagatagaaagttgggatgtttaggatgagggaagcgatacagaagacgaaccatttgttcgcgggttaatagatgaagagaataaaagaaatgaaaacaatagaaaaacagtgaaaaaaggcagacatgaattatcaatgtgattaaaggggttaccattctcggctaattgccgtattttagctcatatatgaacccgctgattagataaatgttgaatgcgagaggtagaaaagagaaatgatgattaatccgtttaaaaacaaaatttggctgtcatcgcccacaatgcacggtgacgaattgaagtatgttaccgaggcttatgaaacaaattggatgtccactgtaggaaagaatattaacgaagtagagcgattgattgctgaaaaggttggtgtccgatatgcagtcgcattatcggcaggaacagcatctctacatcttgccatgaagcttgcgggagaagctatgtatggtcagcctgaaatcggaaaaggagcgttaaaccaacgaaaagttttctgctctgacgttacgtttgatgctacggtgaatccggtagtctatgagggcggtatccctgttttcattgataccgagcgtgacacctggaatatggcccctgtggctctggaaaaagcatttgaaatttacccggatgtcaaggtaatcgttgtcgtacatctgtatggaacaccgggaaagcttgatgaaattagaacgatagctactgcccatggagctgccatcatagaggatgcggcagaatccctgggcgctacttataaaggaaaacagaccggcagttttggagactatggctgcatcagtttcaatggaaataagattattaccggttcatccggtggaatgttcctgaccgattccaaagcggatgctgaaaaggtacgcaagtggtcaacgcaaagccgggaagcagctccttggtatcagcatgaggagcttggctataactaccgtatgagcaatgtgattgccggagttgtgcgtgggcagataccatatttggaggagcatatcgcaaaaaagaaagccatctatatgcgatataaagaaggtctgaaagaccttcctgtgcagatgaacccttatgatgaaaagaacagtgagccgaatttttggttgagctgcatggtgattgataaagatgccatgtgtgaacaggttcgcggggagcagaaagcgctctacataagcgaaccgggtaaaagctgcccgacggagattctggaaactttggccaagtacaatgcagaaggtcgtccaatctggaagccgatgcacgaacagccgtttttccgaatgaacccgtttatcactagtgagggaaatggcagagccaaaacgaatgcctatattaaaggcgcctgtatgaatgtgggcatggatatttttgaaagaggtttgtgcctgcccagtgataacaagatgactgttgaggagcaggagcagattattgagattgttagaagttgtttctgaagccctgaaacataaatgggcaagaaacatgaagaaaaagataacattgaaagtgctgtaggaggacgaaaggatatggggcataaaaaaggcttttttgaaaagcacataaaacgtccccaggattttctgtgtgcattacttgcgtgtattgttttaagccctgtcatgctggtgattgcgattctggtaaagataaagattggttcccctgtcctgtttgttcaggaaagaccgggattacatggagagatatttaagctgcacaagttccggacgatgaccaatgagagaggtgaaaatggagaattactgccggatgaacagcgccttacaccttttggaaaacggcttcgttctacgtcgctggatgaactaccggaactgggggctatcctgtccggacggatggcggtttgcggaccccggccgcttttgtcaaaatatctgccactctacaatgagcatcaggcgagacggcatgaggtcagaccgggctttactgggttggcacaggtaaatggaaggaactttattagctgggaagaaaagtttgatttggatgtggagtatgtagaccacattacatttcttggtgattggaaaatcatctttaagactgtatggactgtattgaaacgagaaggaatcaattctgaaacctctgcaaccatggaagaatttaagggtacagaagctgctgaagtaaaagataatacagaggtataaatatgagaaaattggcaattatcggtgcaagtggtcacggaaaggtagttgcagatattgcaagaaagaacggttacagtgagattgtttttttggacgatgatgagagaatccatgaatgtggaggttatccagtcacagggaaaagtgccgaagctggaatgatagatgctgatgtaatcgttgggattggcaatgcaagtgttcggaggcggatacaggaatccattccagatgaaaaactgattacactcattcatccggatgcagttgttgcggaagacattgtaataggtacaggaactgtagtcatggctggcactgtcatcaacccgggagcaaggataggaaagggctgcatcatcaatacctgttcgtgcgtagatcatgattgtgaagtgagcgattatgtacatatcgcggtgggaagccatttgtgcgggactgtctctgtgggaaatgaaacatggattggtgcaggagcaaccgtcagcaataatgtttctatctgttccaactgcatgattggtgctggatcagtagtagtgaagaatattgatttagccggaacatattttggagttccggcaagaaacactatctaaaagaaacggagtaaaacgatggcattaacattgatgtatattacaaataatcctcttacggcgcacattgcgcaggaagcaggtgttgatcgtatctggattgatatggaatacataggcaaggatgaaagacaaggcgggatggatacggtcaggaatcatcatactattgatgatataaaaaaaatgcgcccgattgttacgaatgcggaacttatggtcagagtaaatccgttacatacggctgctgaggattattgtagctctgaggatgagattaatcagtctattgaggcaggtgctgatgtaataatgcttcctatgtttaaaaccgcggatgatgttaagaagtttgtgagctatgtcgatggcagggcaaaggtacagcttcttgtggaaacagccgaagccgcagctaaaattgattctattctggaagttccaggagttgacgagattcatattggactaaatgatttacatcttgctatgcacaaagctttcatgtttgaactgatttgtgatgacacggttgcaagtctttgcaaaaaaatcaaagcaaaaggcatcaaatatggatttggtggaattgctcgagttgggtatgggatgcttccggcagagcatattattgcagaacattatcgtcttggttcaacagcagctattctctccagaggcttctgtgatgccaatattgtaaaagaccctatggagattgaatctatttttgtaaagggtgtaagcgatataaggctgaaggagcatgaggttgctcaatatagtgaggaacaatatctgaaaaacttggatataattcgagaaaaagtttcggtaatagtagcaaataaaaaaggaaaaggataatttaatgaaaaagatttgcatgataactacagtgtcgttgacacttaaggtttttgttatggaaacagctaaatatttacataaacaatgtggttatgatgtaactctgatttgtgataatgacgaagaatttaagatttcattgccaaattacatacattatatccctgtacatatggcaagaggtgtagatattactggcataaagtccattattgaatttattaaaatctttagaaatgtaaagtttgacatggttcagtattccacgccgaacgctgcctgttatgcaagtattgcagctaaaataacgaaggttcctgtccggttatattgtcagtgggggattcgttatgttggaatggacggaatatctcgaaaaatctttaaagccattgagaaaatggtatgtagaaattcaaccgatatccgggctgtcagcccaatgaataaggcatttgcagtatcagaaggactttatccagaagaaagagctattgttgtaggaaaaggcggtacgattggtgtagatatgcagcggtacgatatttcaaaaaaggcagactatcgttccgcaattcgcaatcaatacggtatatctgatgaagcttttgtatatggttttgctgggcgtgtttcggtggataagggctttacagaattactgacagcatttcggataattagagaatcggagccgaatgcgaagctgtttatcgttggctctatggaagataattgcgatgttccggttgagattttggagtgggcgagaaaatcagagcaggttgttatgaccggaatggttgacgggtcgaagatgaatgaatactattcggcaatggatgtattggttcacccgacatatagagaggggttcggaatggtgcttcaggaagctggcgcattgggaattgccatgattactacaaaaatccctggcgcttcggaggtaatggagaatggaatctcttgtgtactcgtagagccgaagaatatatctgagcttgctagtgcaatgaaaaggttgatttcggatgtaggacggacgaaagagattgggcaagcagcatttgaaagaacaaagcaatattataatcgcccaattatgcttgaaaatcaaaaagcagactatgaaaagctattaagtaaacgaggaactcagacattatgagaattgtattaacagaaaaggatttagataatagtggatttccctctgatgtacgagtgatgaaaattacatataaaaccatagatgcttatgaccataacagcgatgttattgcaattgctggttcaagagcaattgcgattaaggctgacaagatggattttcctggtttgaagttttttcagttaacaagtgctggatttgatgaagtgccattggaagaattcagagatagaggtgtgatggttgcaaatgccggaagtacatatagtgttccgattgcagaaactgttgtgcttggaatgctgcttatggcaaaaaaacttcactcaaatccgaacaatcgtcatgcaaagattcaacgtcactatattgaaatccaggaactgtatgtaaagaaggccattattctgggggctggtagtattgggacggaaattgccaaacgtctttccgggtttggcatgattgctgatggatatgcccaaagggaaaaaataagaccttatttcaatcgcgttatttgcggacgtaaagctttagctgaagaaattggaaactatgactatgtaatttctactttgccgggcagtgaaagtacaagaggtttttttgacaaagagctgctcagcagaatgaaacagacttcggtgattgtgaatgtaggacgaaaagcagtattcaaggaggatgatttctttgcggccctaaagaccgggtctattggcggagcggttctggatatgtttgagagtatccccaatccggttacgaacagattcagaaggcttcgcaatgttatcatattgccgggcgtagcagccatttcacaggaagttaatgtacgattaaaaacgtattgtgaagcgaatatattatctgctatagaaggaaaaaaggtaatgggtatagttaatgaggtagaataaatgtttttcagtattataattccaatccacaattcagaaaaatatctgagacaatgcatagatagtatattggcacaaacttgcagggattttgaagttattttggtcaatgatggatcggaggatgatagtccgagaatttgcgaccaatactgcgacgaagatacgcgatttcatgtaatccaccgaaaacaaggaaaaggagccgcatcagctcgaaatgcaggaaccaatatggcgtcaggagactacattgtctatattgatagtgatgattatatagaagatgtaatgttcctggatgatataagggaacaggcagaaaagggatatgatgtcatttgttataagttcagaaaatattatgaggatactgatgaaatgacagcctgcactttttcaatgccagtaccaatggagagtgaaacaataggagactatgtaaacagactcgtgaaatgtgatgcgttttactgtgcgccttggacaaaagccattcgcagaaaaatcctggtggatggaggagttgaatttaaagaagggctgttgagcgaagatcaagagtggtattaccatgttttgattggagcaaattctattattggcattgacaagagctatattatatacaggcagcacaagagttccacttcagtatcctggacaatgaaaaatcttacagacacaattagcataatcacgttttggaagaaagaaatagaaagaattaatttaccagatgactataaaaattcaattttaaattcaatggcaaaattatactgcaatttgcttattgggtatacaaggtattctaatattgataagaaaagcgagtataataatttgaaaaaattggctggattgatggattaccacaggaatccgagagttaatactttctatagagtatataaggttggcggatttactgcattgatgatggtattgaagataatttgtaagttgaggtagttatagatgaagaaggaagatttcccaaaggtattggttgttacaacgaatgcttggagggataatacaggaatcaatacactgatagagttttttaaatgctggaatccaaatcgtattgcacagatttatacaaaagcaacgtttcctaaaaccacggtttgtaataagtttttcagtatttcagagaatgctgtcatgagaagcgtcatgaacagaagcattacgacggggaaagaagttcataacgagactgttgattcaattatggacaatccatcagcaaaaaaagaacaaaaaatatactcttcctataagggtaaagtaagggaattattgtccatttgcagagaaattgtttggaaatatgggaaatggaaaaccgcagagctggactattttattgatgaatttaatgcagatgtgctgtttattccgatttatccaacaatatatatgggaagaatccaaaagtatattattagccgcactcaaaaacctgtggtgtcctacttagcggatgacaattatacctacaagtctgtacataaaaatcccatttctctgattcaccgacacattctgcgtaaatatgtcaagtacattattgaacatagcacgaagctaatggtgattgcaccaaaacagaaggaagagtatgacaggattttttgtacggatagcgtagtcatgacgaaagggattgattttaatccgtttgagtcttatcaagccggaaatccgattaagatggtatacacgggtaagctgattatcggccgttggaaatctcttgcagcaattgcggaggcttttggaggaatcaatcgggatggtattaagattacgcttgatatttacaccacagattctttgacggatgaacagaccaaattgctgaatcgtaatggctgctctgttaaaggtgctttgacattggaacaggtgaaggcggttcagaaagaagcggatattcttgtttttgtggagagccttgagaagaagttcagaaacacagccagactttccttctctactaagattacggattatctgagaagtggcaagtgcatttttgcaatcggagataaggacattgcaccgattgattactttaaccggtatgactccgcagtgacggctatcagctacgagcagatttcagaaaaactgactgaactggtgaatgctccggatttagttttagagtatgcaaaaaaagcatacgattgcggagtggaacaccatgaacgtgggcgtatggatagtattctaatccatacaatcgaacaggcaaatttgaagcagcgggggaaaggtaatggaaaataaaattacaaaatccgtgtatccgggaattgacatcggaaaatttttttgtgcatttttgattctattttaccattattttagcgagcatggttcactgccaggtctattggaagaagcgctttcgctgtatgctgtagccgtagcgctctttatggtcatcagtggatttcttctttataataaacttgaggggatttataacagagaagaacgctggagtattgtaaaaaaacaggttttgagaatttacagaatataccttttgtggagcattccttatttgctttttacaattttacgctgggactggaattctatatctgctggttttgtcttatggaaaattcaggggtgggttttccaatctaccttttatacaatctggtttatgccaatgttggcaatcggcacactgctgactttttggctgactgaaaaacttcccaatgccgctgttaatgtgttagcagaagccttgttgattcgaaaaatatcgggagggcatacaggaattgacttaacaattatgatgattcctacggtattctgtattttagggtttctgatttcaatccgtttgccagatggaaaatatgcaagatggatgcgaaacatgagtatactgatttttatgagtcagagactatttttgacagtattaccgcagtgttttccggtggtgtttttctttgtatttatgaataaatatattggagcaacagcgattatcttggtgactgttcttttttcatcgcttgttattcaaatatcaaaaaagaaagcatttttcaaaaactatattaaccctatagtgtaaaaaactgaatactacaggataagtagaagtgtgcgccaaatgctgtatttgcggggcgaataaaatgcaaagggagattgagtcatgaaagtaatgcaaataaatgcagtatatgcttctggaagtacagggtatattgttagtgatattcatacactttcgattgagaatggaattgattcatacgttgcatattctacatcacctttgtcgagaaacgaaattgttaatggatatcaaataggaaatacttttgggaaaaagattcatgctttattgggaaggataaatgggaagcaagcatacttttccaaaattgcaacatggaatttattaaagtatattgaaacagtagaaccggatattgtgcatttacataatctacatagtaactttatctatctaaatatgctccttgactatttagcgaaaaaaagaataaaaacaattattacattacatgattgctggttttatacgggtgggtgttttcattatgcatctgcaagatgcgatgggtggttaaaagaatgcggtcactgtcctaagaaaaaaaaagatacctccgcattattctgtgatgcttcaaagaagatattaaaggataaaaagaagtatttgtctaaggtagatgatttaacaatagttggagtgtctgagtggatatcgcatgaggcaaagaggacttttttgggatgcaaaaagattattacaatacataatggaattgatacagatttttttaggccaagtttttctgactttagaataaggaatgggattggaaatgaaaaatttgtgattttaggtatagcaaataaatggttattaccaattaatcagacattattaactgcgatgattgattttttgtatgaagatatggtttttgttatgattggctgtacagaaaaacagagacagatattacccgaaaaaatcaaggcatttcccttcatttttgacagaagcgaattgagaaatatttattctgcatgtgacgtatttacgaactgtacatgggaagaatctttatctttagttaacgtagaagcacaagcttgtggagttcctgtcgtcacatattcagacactggggtatatgaaacagttgatggtatgtctggttttaaagtaagaaacggagacattaaagagtttttagatgcgattcagacagtaaaaaataagaagaaacaaagctattctaaaaaatgcagagagtttgttattaaggagttcaataaggggacaaactataagaaatatttagaattatataaaaatgagtgtgtaatatgagtgaaaatagaaataatcgaattttaacgatagacacgatatttatagtgttcttttcaatgtattatatattgccttcggtttcggcaaaattgacattcctttttccgttagcacttgtctttgtttatattgtgataggtacaatacgaaatggtatgaaattgtcgactattattgtaaaatatttatttctaatcgcttttatatcattcttgtacatgattttgactgatgcaagttcaatcgctgctgatgtatcagaccgaggattaaaaaggtttttgagtaaatattatcaaatggctatgatgttttttcctctactttttctaaagagaataatagatttttctccttttagagtaaaaaaaattgtacttattttctcgtatgcactttttgcatatgtaatgctttttacgatacaagaactaagaattaatccaaatattacaagagcgtgggcaggattcaaagaaaacagtgcaaacaatgttgcaaattattatttcgtttatgcaataccttttacaatagcgataagcactatgttggcgtgtaaagcaaaaagagtcgtgattaaagcaattatggtagcgctgattatctatcaggtttattttttgcttttggcacaatatacgttatccgttttaatatcgattattggtatttgtgcagaaatatattgtaatactaagcctggaagaaataaaacagtccttgtattgttatttgctatacttgcaattttatctccgtggcttttaaaaacggcagcatcacacgtgccgtctgaacagatggcaattcgactatatgagatttattatttcttagtgggaggtgatgtatcaggatacaatttgaacggacgaatgacattatatactgaaaccataaaagcttttttgaaatcaccattttggggtaataggcatttggattttgatggtcatgcaacattcctgactgtattatcagatttgggattattagggggcattccattctattatttgtatttttcttcacagaaaagagtgagagcgattattaatgataaaggtaattgctactggcctgtttttctaatgttggctttaatgggatttacaaatcctatacatacagcactaccgttaatgtatgtagtatggtttttagtgccattatcaatcgaaacctttatggaatatgaggagatgacttatgaaatcgtggaaaactgatgtgtctgtgttgcttatctttttcgtaagagatgatacttttgaaagagtttttgaaagtgtaaaacaggcaagaccaagaagattattgctttggcaagatgggctgagagaaggaaacaaaggagatttggaaggaattaagaaatgtcgaaaaattgcagagagtgtggattgggaatgtgaaatttataaacattataacgagaagaatcttggttgcgatccatctactttttttgcttttaagtgggccttttctatagttgataagtgtattattttagaagatgatcaggttccgggacaaagctatttcatgttctgtaaggaacttttagataagtatgagtttgatgaaagaataagccatatttgtggttataatatattcggagttgcaacatggtgtccgaatgattatatgtttgcgtataccggttctggtgcatgggcaagttggcgtagagtagcagattcttgggaagataggtatgaatttttgcacgatgagtacgctcttcataatctaaagcaaaaatacggaaaaagaagtgaatcgtggataaaaactgcgattaggcacgaaaaaacgggtaaggagtattgggagagcatagttggtctgggttgtgctattaattcacgttatgcaataattccgaaatacaatcttgttcagaacctgggaatatctgataatgcaacacatagttcagtgaatgatttgagattgataggaaaggatgaacagaaactatatttgcgaaaaggtgaggaaattacatttccacttaagcatcctacgtattttattccagataatgtttatatgacaatgctagataaaaggaacaacatgctattcattgttaagggaaagactcaaatggtgataaatatgattaaatatagaaaatttgatttattattaacagctatcaaacgaaaaatcacatcgaaaattaggaggtagggtggtgattcctgatttctagtattatactcatcaatctaagcatatgattcaatggttggagggagggctgttgagtatgcatagttgggaaatagatgttgctgttattggctatttttatttgcaaaggtttataaaacagagagcagacatgcctctggatttgtagggtcttgtgtttatattgtagtgataagaatactgttaaggatattatgcatttgctgaagttaaaatcattttatccttatggaatgataattgagaaggattaatatgagtaaatacacggtttgtggatatgatattgacatattacatgatagaatgctgaagattgcaattgaggttgataagatttgcagggctcatggatggaaatgctcgttatatgggggatctgtattgggagctattcgccatgatggattcattccatgggatcatgatatcgatatgtgtatgcccagaaaggactatgattgtttcgtcaaatatatgatgagacatccaattgaaaagattttttttagcaattataaatctgagaaacgatatccaaatagttggggtaaggttagattgaatggtacagtttttgtggaaaaagaattgtcaacgctcaaagagttgcataatggggtatttatcgacctgcatccaattgataatgtaacgcccctgacgattaatttgcaggtgagaatggcaatgttttggtcatgtattgggaaggtcaagagcggaatttattctggctcaaaaaaaaagatacaaatttataaaatgttttcatggttaccatatgaaataattaatacttttcgggaatttgcaatgaaggtcttaaaaccgtttaaaacaaaatatgtctataaggtggctcatcctaataatggtatatatgtgattgagagaagcacttttgaagatttaatggaacatcaatttgaggggtatcaattttttattccaagaaattatgatgaattcttaacagagagatatggagactatatgcagattccaccggaatcagaagtgcatgaatgctgtacatcgatagtggagtgtgaattatgagctttaatgaagaattattatcagttattatcccggtatataatgtagagacttatttgaaagcctgtataaattctattattaaccaaacatataggaatattgaaattattcttgttgatgatgggtctacagatatgtgtccacaaatttgtgatgaatataaaatgcttgattctcgggtaaaagtcattcataagaaaaatggaggtcaaggctcagccaggaatatgggtattaatattgcaaccggaaaatatgtggcgttttgtgacagtgatgactttattgaacctaatatgtatgaatcattaattacatcattagtcaatacgaatagtgaaatggcgatatgcggatttataacccattcaggtattagagtagtaaattcaaaaattccaggcaagaattatgtatggggctcaactaaagatattataagagagtactttaattcagcatatattacgggaagtccttgcaataaagtatttctaagacatatatttaaagaagttagatttccagaaggagtagctagagaagatgtgtacataatgcatcatgtttttgataaatgtaatagagcggttcatgtgggtgaatgtttatatcattataatattcgtgaaggaagtaacgagcatcaattgtttcatcctaagtatttaatctcacttgaaattgcagatgagagatgcaattttataaaaaatagttatcctgagttattacctttagcacagaaatcatgttatggtgcaagaatttctgcaattaaaaaaataaccaggtcgcacatgattaaagaatatagtgaaatctataatagattgattgattatttaaaaaagaatgaagcaccgactaggaattatcaaagaataagattttttattttatacctaccgtttatatataaaattgaaatggattataagtattattggcgaaaaaagataaaaaaaattattcttagattaaaaaataatgaggtttagtgaaaagaatatgatgagtgagaatacaacaaagcagatacgttttggtgctgtactttcttacggtcaaatgataatgagcattattgtaggaatagtttatactcctattatgattcgaaaatttggtcaaagcgagtatggattgtataatacagcagcttcagttatttcaatgctttcaattttgagccttggatttggtagtggatatctaaagttttatgcgcaatataaaaccgttgataaaaagcaatctatatacagattaaatggcttgtttatgattgttttttcgataattgggattgtagcgctgataataggtctttttttgacgacacatttggaaatggtttataatgatggtcttacggataaggaatatagaatagctaaaattttaatgcttttattgactcttaacttgtcgatatcatttccaatgagcgtatttaacacaattttgtctgctaatgaaagatttatttttcaaaaaataataggtatgggaaaaacaattgtagcccctttgctgataatcccacttttatttgcaggatataaatctattgtagttgtttcgataaatgttctgctagcaataatagtagatgtgcttaatattttttatgttattcatattttacatgagagatttattttttttggttttgaaaagggcttgtttaaatctatgtttgtctatacatcgtttattttgataaatactatagttgggcaaattaattggaatattgataaaatattattaggacgttttcaagggactgcatcagtggcgatttattctgtagcgtcatcattacatatatattatgaaaatttttctacatctgtatcgaatgtttttagaactagagttcacgttattgtgaatagttttaataacgattcactagaacaaagaaatcagctaacaacattgatgataaaggtagggcgcattcagtttgtaattttaggattggtttttacaggatttattttttttggcaaacagtttattgtaagatattgggcaggagcagattatgcggaatcgtatagcatagcgattttattaatgctgtgctcatcaattgttttaatacagaatgttggaattgatattcaacgtgctttagataagcacaaatttagaagtattgcgtacttatttatgtccgctattaatctggttgtgacaataattctttgtaaaatttggggtgctttaggagcagctataggaacagcaatgtcagttattatagtagatggtcttattatgaattattattattttaaacagtgtaatattgatattgtgttgttttggaaagatatttcacgagaaagtttgggattaatattgccaatattattcggaatattctgtgtgtatataaaccagattaatagtatgattatatatttatctactattattttgtatattattatatatcttgtttctatatatgctatatccttaaatcgggaagaaaaaaattatgtaaacaggattctatcaaagttatataggagaatagtatgaaaagagaatatatagagttgttaaaaatacctgaagctgtacgaattccaatttttgccggaaagctttatcagtttttatcaaaaaaagaaaatgtattaattcagactgaatgtataacagagaatgctttgaattcaaaaaaaagattagaaaaggttattgcatcaatgacttcttttccggcacgtatcgaatatgtacatattgcattgaaatctctaatgactcaaagttacaaacctgatcgtataattctatggttagcagaggaacaatttccagaacatcatttgccgaggcaattgctagaactacggaattatgggcttgaaatcaactggtgtgaagatttatatggacataaaaagtactattattgccttttgaatcaacaaccagacgaagttattataacttttgatgatgatattatttatcctgttgatgctataaaacgcttaatggataaacatattcaatatcctgactgtatagtctgtgaacgtgctcaagctatagattatgaaaaggatggcacgctgaaaaatccaggaagatggaaaacaatttccaagattggatgcaagcaaccatcttatagcctgaatccgtcgcccggaggcggttgcttaattccgtataatggtttttacaaggacgcaaaaaatgcaaagaaaattagagagttggcgtataaaaatgatgatttgtggtatatgtttatggccgctgaaaataggaccaagacagtaaaaacacagaaatatcacaagccattttctttaattagtgggtcacaagcggtgcaaatggccacagaaaatgttttggggaatcgaaaccaaattattatggataggcttagcaaagagtacccaatggcttatgagcggattttacatgatgaggattgaacaatatggagaacgagaagatttttgataaatttcttcagataaccccattcatatgtgcgttaatggttgttggtatccattcgtacaatggggggagtggtatcactgcgcgaatagagggaagcctatctcatggtttatttacagcagcagttccaatctttatgtttctttcgggttttttgttctatagaaatgcagaaactttgagagatgtaattgcaaaacagaaaagaaggttgacgagtgatttaataccgtttttgggttggtctggactatattattttatttttacgtctgcgcatgctttgttgacttcaaataacgcagagatacatatatgtattggtaccatcatcaaggggattgttttttataaatatgttttcccaatgtggtttttgttccagttgatagtatacattgtgcttgcaccagtcctttttaagttgctgaagaatacaaaggtatctttgtttgtcttatgtattgctgcatttttagcatactttaaggttagctgggcagtagatgttgataatgacattagaacgatattcgccttcaatttctttttctattattttgcaggcgcaatcgcagtgaaacatcaagagcgttttattagggctattaatcgcttggcaaggttcccattggggataatgggaatcattctaattatagtcaaaatatttaccccatagactacagtatacattatgtggatattgtagaaaagtggaaaatatattactgtatagacaggagtgtgtatgatgtacaatggagattgtgaggtatacataattagatattttaatgtatggttttatttatttgctaaaacagagacagataattataagattaaaatgctaggagaacatataagtgctggtaattctatgaaaatgaaagatattcattggtggtgtaccagacatagcataaagtaccagatggaatttgaatacagaaaagagtatccaattcgagctaatatatggaatttttattcatactgtagatttaagttggcaatgtcttatcccaatagtggaagaatgggcccaaaataaaacatgaaagtgcagatggtataaaaaaggcaattttttgtccaagttgcttccaatatgtggtataattgaaaaaagtattggcaggagggctaaagatggaaattgtttttcaaacaataagaatcattgattatgagaataatgttgtttatgtacgggatacgccagaaacattttctgactatgtgagaacattgattacttatataaatgataattcctctattagagaatatcatacacggtcagctaatacagaagtaataagctgtattttagatatagtaaaaaatcagatagatgccaattttgtaacagataaaatggattttatagctaaaagactgttattaaaagagcaagaagcacaaacttccgtggcacatatgaatacaaatgtacaaaaaggtagtttaatacaagctcttatgtacgatgaagagatggatgagcatatatatttgctggctaaggtggaacataccgattttgtagacgatgaagattttagctttaaatccggattttcaaaagataaaactaaactttggaagtcctgtacttttagaattgacgatcccaatgcaactaatttttcagcaaaagtatattctaataatattgcaaagtattggtatgataattttttagaattagatcaagttgtaagtgacgaagtaaatacagataaagcatttcgtgcaatagatagtacattaaatagaaatgtaaaaggtattgcaccaagagatcacacactgcttagaaatacaatgattacatattttaagtctaatgattatattgattatgacactatgattcaaagtacattggaaaactataaaccaacggaattggaacaagataaaatggaaaaagtattagaaaagatacgggaattaccagagaaatacaaatttgataagcagtttaacacggtaccatcagttataaatgcccgtattagaaaggtttatgatgtttgccacggtgtacagttaagaataacggatgctatagacgattttgatgaaactataaaagcatatagagataatgatggaaatagatatatacaaataaaaacagataatgatttgacatttagaagattttcaaataaataaaacaagaggagggggattatgcttacagagttgattcaggcagcaacaataatagatagtgtcgtttcagaaagaatgaaagtatatgaagcctcctttaaatttgaggttaaaaatgctccagagtatgggtattttttggatatcataaattccgtttcacaaagagataaaataaaaatagttttgcaagatgaaacagaacaggtttatgatttttcattaggtaatgaagaggattataaggggtttattaacgacacattagaagatgaaatcataaatgttaaagtaaagattgataaggaagtggttaataatcatttttctatttatgcatttgatgaatttgttaaagatatactttctttgtctttagaagaagttatgattgcattctctaatttattaaaacagtcatcaaattatttagtgtttgacgtatatagtcccgttgcaatgtttgcaactaaaactatgttttttgtacccaatggaaatggtatggtaaatactgaatttaacagaaaaagaagaatggaggagtgcagggaggtttcatacttttataattttgacatttttgaggtgctgccggatgattttaaaattacgattgattacgaaaacaacccattaagagaagtatttcaaaaaattatggttttattatctatcagttttattgcaacatcatccacaataagtaatagtcaacttaaaggtataataaatggtcaacgtacaatggaatattgttgtaatataagtgagctaccagataacaagatcttgtacagtatttacaattggatttatacagatgggaatccaattgataaagcaatcattgttagaaacgtaattagtttgcattgtaagtacgtttccataacggaaatcgatgaaaaagttatggcttcaatacagtctaattataacctttatttaaaagaaaatgtaaaggcgtatttagaactaaagaataaagttgcggaatttataagcgataccgtttcaagaacaggagaatatgcgactggattattagataaatttaagtcaaatatcattgctatatttggatttttgtttactgtgattttggctaatatagtgtcaaatcagccattagataatctttttacaaaagaaattactattatagtagaatgtgttttactgggttcttttgtatatttaataatatgttactgtcaatcacgttatgaaatcaaaaaagtatgggacagttatgaacaacttaaacttaattacaaagacatattaacagatgaagatttatcagaaatatttggtaatgatgaaatgttagaaaaaatgaaaagctcaattcgtaaatccgaaaaaatatatttaagtctatggattatatttttgctcggatcaattattgtagttgagagtttaagtgtttgtccagtatatcctaatatattaaaaactttggagtatatatcagagttggcattaagattttcaataaaaaaataattattatataaaatggaggcaaaattaatgttttttgcctccattttttaagaactattaagttaaaagtaaaaggcaatcatgctttatttatcaaagtgtgattgtcttttttgtgcttaaaaacggatgaaaatgtaaaggaggaagaatacaatgattcgatttatgagtgatacacgttatgctgggctggaaaaggaaatgcagtagatactctcgtatctactttttcttgtaatacccaaagtccagaaagaaccatcgtacatcacagcgccttttgtctattactcaactctgtttcccataacccggcattctacagccggtaaagcttttttccattttcccaggtgaccttcatgacggtttccgggtccactccctttagctggctgacagcttccaccacatagggaagattcagggaagaattcctttttccccggtaggggaccggagcaagatagggacagtctgtctccagaacaatggattccagaggtatatactccaccacctctttcagtttcctggcattgctgaaggtaaggacacctccgattccaaggaagaatcccatgttcaggtattccctggccatttccctggtgtaggaaaaacaatggacaacgcctcctatatccccggccccggacgccttcatcatatccagggtatcctttgcagcatccctgctgtggatgattatgggaagctttacctgcctggccaaatccatctgtgcctcaaaccactttttctgtatgtcatgggccggctcctcccagtaataatccaggccaatctcacccacggcctttatcaccgggcggtcacactgttccttaatccactgaagtccctcctggtccatctcccctgtctcactgggatggactcccacggatccgtatatccagtcatgggcttcggccagttttatggtactccggcagctctccaggctggctgccacattcatgaccgcaccgattccggcttcctgcagacgtcccagaagctctgtccggtcctcatcaaatgcctcatcgtcataatgggcatgggtatcaaatatcatgattttatactccttttgctatccacatgctcaccccatacagcaccagaaaatgtaccggataaaacacgcagaacatatatttaagctgaaacgccccccgccttccattgtacaggacaatgggcacaaaggacaaggccgacacacaatagcagctgatgctctccactgcacagattcccactccggcaaccagctgggccgtatcattgcggcggaagcagtacatggcggctatgaacagcactcccaccacattataatcaaactgcagcacccatgacagagcgcatcctgctgccagggcagctgcccgcagccccaggctgtgggtgtactccataacagccataaccagaatgcctgcaaacagggtaaacatcatattctgataatggggatagaatggggtatggtatacagccaaatcaaagggcacctcggataacagggcaaacagcagcattctgagagcgtactgccggcggtccctggtgcgcacgaattcctccgctgtgagataggccagaatgggaaagcccagtctgcccacatagcggcagacctgtcccgcaatcagccagtaatgaccggaaggcgtcagcaccaccgcatgataaagagcgctgtccgttccatggagaatccctccctgaatcaccacagcaccgatattatcaataagaattgccacaattcccagaatcttcagctggtttcccgtaagcccctgccggcggccggcgtatggaccgcggctgcgttttctccccatatcgtaccctctttagggccatataagccccctcatgttttaatttcctttcatcatactccaaaatggcgaaaattgcaagtttctcccactttaggtcgattttcccatgatacagggtatacccctcccattttcacccagatttcagtgcttttacatacaattacaggattccaatatttttttgcttatgcctgcccaggatatgcggcttaaatccggaagagaggccgtatctgccggaatggcagctgccccacattttgcgctggctgtttcctgagccatgccggtcatatccaaactccggcctatggcctctgccagacgctgttcaaatccgggaagctcctgttcaaccggttcatccgcatttacaatggcgggaagggacacaaattccacgggacatgttccgatattttcctccagccagggcctgacccccggcaaatccgtgcagaccacctttaagccgcaggccagggcctctatcaccacaaggggaagaccctcataaaaggacgggagtacaaaaacatctgcctggttcatctgttccgccagccgggactgttccagccttccaagaaattttaccggataaggcgactgctctgccagcttctcaatggcttcgtattccggcagatttccgtatccgccggccagccatacctcaagcttcatggacgccggagcctgttgcgcaggcggcacctgcccctgcctatcctgcccctgcctatcctgctcctgccgctctatgccctctccctggcactccgccagatacgtcaggctgcgcagcaggctcataaccccctttttttcggacagcttgcctgcgtatatcagccgcctgaccccatccgcctttttaaccggcatataccggaaaacagaatcatcaaagccgcttccaatcacctccagccgttcctccggcacaccgtatacccggctgatttcctccttctgctccctgtggaggcagaacaccttgtccagctcctttatgcgggccaggatatagtcccgttccaggccgtttttctttacctggcgcaggcccgtgccatggcatatggctgctgttttatactgggggaatgcctcccgcaccacggctgtaagcagatacagatggtggcacagaatcaggtccggccggaagccctccaccgcctccctggtcttttccaaaaacgcctgtttaaacgcatccaccatatcgcctgtcatccggctgtatacggtgctctcatagggcatctcatccgacattcccgctatgggaaagggcaggctttctgtcctgtaatacacaggatagacctgggtcccctcaggaaaatgcatctcatcctccttatagacgcctgccaccactgcctgctcatgccccagtgcagcaaacccttttaccagaccggtgagataaacaccgctccccgtgctatggggtttctgggccgttatgctcagtatcctcataatcccctccgtttctcctgaaaacatgtaataaaacacattatctaaaacaggagcaggtcatcaccgcccgctcctgccgtccgggcagccatgaaacgcatatgcattcaatcactcctgcccggtatatatcctattcttattaacattttgtcagcagatttctgctcctgccggcatactcttctccggtgtcataagcgccagattgccctctgcatcctctgcgcagagaatcatgccctcagacaccatgcctgccagcttggccggctttaagttggtcaccaccataaccttcttgcccaccatctcctcaggagagtagtaagcctttatgccgctcaaaatctggcgcacctggcttccaatctttacctgggaacagagaagcttcttggacttgggaactgcctcgcacttgatgatttctcccacctggaactgaagctttgcaaaatcatcataggtaatctccggcttggcctccaggtcaatgccgctgtcctctgcctgcccggatgctccgtccccgccgccagcctggtttgtgtctgccgcagcctctgccgcatgcatggcctctaccttctccagcacttccttgatatccatacgtgcgaagagaatctccggcttatccgtcaccttctgtccgcttgggtacagtccaaaggtatccatctgggacaaaccgcgcttgcctgtacgaatctgcgccagaatcttctcagatgtctcaggcatgaaggaatacagcagggaagccccaatggcaatggcctcagtcagattgtaaagtacggtggaaagcctgtccttctgttcctcatccttagccagtgtccagggtgtggtctcatcgatatacttgttgcatcttctgaaaatgttgaagatttccgtcatggcatccgccacgcgcagctgctccatcttggcatccgctttcttcacttcctccagcactaccttcttaaggtcctcgtccacctcctgggaaacacccttgtcgctgaccacgccgtcaaaatacttgttgctcatggaaatggtccggttcaccaggttgcccagtatattagccaggtcagagttcatgcgctccaccatcagctcccaggaaataacgccgtcattgtcaaagggcatctcatgaagcacaaaataacgcacggcatccacgccgaaaaagtccaccagcgtatctgcatagagcacattgcccttggacttgctcattttgccgtcgccctgcagaagccatggatggccaaatacctgcttgggaaggggcacgcccagagccatcaggaagatgggccagtaaatggtatggaaacggatgatatcctttccaatcaggtgcaggtctgcgggccagaaccgcttaaactggtctgtgctattgccgtcacaatcatatccaatacccgtgatatagttagtcagcgcatccagccatacataggtaacatgctttgaatcaaaatcaaccggtatgccccagctgaaggtggtcctggacacacacaaatcctgaaggcccggaagcaggaagttattcatcatctcattcttcctggacacaggctggatgaactcgggatgctcattgatatactcaatcagcttgggagcgtacttgctcatgcggaagaaatatgcctcctccttggcaggctttacctcgcgcccgcagtcaggacacttgccgtccaccagctgggactcagtgaaaaaggattcacagggagtgcagtacagcccctcgtagtatcccttatagatatcgccctggtcgtaaagcttcttgaaaatcttctgcacctgggcctcatggtcctggtccgtggtacggatgaacttgtcataggaagtgttcatcaaatcccaaatccgctttatctcagcagcagccttgtccacaaactccttcggagtcacgcccgctgcctgggccttttcctcaatcttctggccatgctcgtccgtgcctgtctggaagaacacgtcaagtccctgctccctcttatatctggctatgctgtcagccagaatgatttcataggtattgccgatatgcggcttgccggaagcataggcaatggccgtggtaatataatatggttttttacaatcctgacacatatgattaaatccctctttttctgagcggaaacaaagggccgggacagagcctgcctgtatcatgctctggctgtcacagcgcccaatccgcttattttaatagttttaagtataagcgtttcccccatgttcgtcaagacgtgccccctgttttttccctctttggaaaggcccggcagttttttcactgctcataagttgtaatttccgctcatatactatataatgtcgtaatacaaaacagaacagacaccccaatggaggatttgtttagaatgagacaacgaaaaaccatatttttacaataccttttatccctgctcctggtcataagcctgacagccggatgcacggcgcccgcacgccctcaggcttccgctccgccggcaaaggaatccgctgcccgggaaagcacacagtcctatgaacagtatgaaaagaaaacccttgatgcccagacgtcctttgaccagctgaccacggacctgttcctggatgaagttgacaattcgcttatcacgcttcactacaccctggccaatccggccgcctacggcatcactgactacgataaaaccctggggaccgtatccctggaggacagtaaacaggctctgaatgatgccaaatccctgaaagtacaactaaatgacattgacagccggctgctccgtgaagaccagctgctcacatacaatatcctgtcgtcctatttaaacaccatgctgaccagtgaaggtctggagctctatgaccagcctctttcctcatccctgggcatacaggcacagcttcccatactgctgtccgagtatgtattctacagcaagcaggacgtagaggattacctgtcccttttatcctccatagacacctactatgacagcatcattgcctttgaaaaggaaaagaccgctgccggcctgggactgtgcgacacggtcattgaccgcatcctcaaatcctgcaatgcatatctgctggatgcagaccacagcttcatggcagaaacctttgcggaacgcctggagcaggtggaaggtctgacaaagcaggaaaaggatgatttcattgccaggaaccatactgccattgacgaacatttcgtacctgcataccagaagctgattgagggactgactcccttaaaaggaaccggaaccaatgacaagggactgtattacttccctcagggccagaaatattaccagtacctggtcaatgcatatacaggaacatcctatcaggatattcctgccctgaaaaaggccatgagcagccagatgatggatgacctgaccgctatggatgagctgctgaccgaaaatcccaccctgggaaaaaaactgtactcctattccttttccctcaccgacccaaaccagattctggaggatttgagaaaacagtgtgcaaaggatttcccggccattgaggattatacctgcagcataaaaaatgttccggctgccctggaagccaccctgagcccggccttctacctgaccgtacccattgaccgtcctcaggacaattccatctacatcaacaacgggagcaccaacacagccaggaacctgtattccaccctggcccatgagggctatcccggccatatgtaccagaccctctatttcaacaaacataacagctgcaacctgcgaaagctcctgagcttcagcagctattccgaaggctgggccacctatgtggaatactattcctacagcctgaacaacggcctggacccggaccttggagaactgctccagcacaatgcagcctttacccttgccctgtatgccatcctggatgtgaacatacactatgaaggctgggacatcaagcaggtggaggattatttgaaccactacttccgcatcagcgattcttccgtcatcaccactatttattatgacattgcggagaatcctgccaactacctggaatattatgtgggctacctggaaatcctgggaatgcagcgggaagccaaaaaaacccttggaagccgctataccaacatggaattcaaccgtttcctcctggatatcggacccgctcccttcagcgtcatcaaaccctattttgcagagtggctgacccggcagaatgaggccggacagaaggcggttgaaagccagaatccaggcagtaaccagcggacagacggataaaataaaacagtcttacgccatccatgcatggcctgaaccatatacgtatcataaagcaggatttgcttccccaacgggagaaatcctgctttattatattaaaatccccattcagttaagccgcagacatccataaccggttatccccgtccgccttcccagcccctttatccggaaccattaacgctctttccttttccgtttcaatttccccataacagacagacctcccgccactcctgtaaaaatccccagcagcacagatgcccgtacaagccccggaaatacctgggcttcagtgagaagcccgccttccagcccgcccagacttcccatgccgtccaggtcggccaccgcaaaggcaaggccccatcggtacagccagaacagaagaatcagcggaatgaccacccctgccgcccccatgacaacggcctccgccataaaaggaatcttcacaaagccttcccgcgctcccataagccgcataacccttgttttctccttctgggcctcaatgcccacggacagggtattatgaatcagcagcactgatatcaggactaaaagcactgcgcttccggtaatcagacgggccgcgccctggcgcagccttaaaagcgccataaccgtatccgccgaatgggtggttttcctcacgccttcaaggccctcggcatactccacaaacccctcctggctgccaatccggtctatatacacctgataatttccactggcggccagaggattatcctcctcaaaaattccgtccaatgcctctgcattttcgtaatacttctctttaaatccgctccaggcctcgtccgccgacacatacacggtccgcagcacctccggacggctctgaatcagatttccaatctcctccacccgttccggcaggataccctcatcaaagaatacagccacatagacttcctgctccgtcctctttaccatactgtccacattggccgccgccagataaaaaaggccgaacagaaaaatacaggccgacatggtaatgacagacgcagccgtatacactctgtgatgccacaggtttttaaaccccaggcggaacaggtaaagcaatgtcctaatgcccatatgccattccctcccttgcaaggtccctcaccacctgtccccggcgcagcaccacctgccttctgtgcatgctcctcaccagctcctgattgtgtgaaaccaccagtaccgtggtcccctgactgttaatccgctccagcagacgcatgacgtcctctgcattcttctggtccagattgcccgtaggctcatccgccagaagcagcaccggacggttcacaattgccctggcaatggctgtgcgctgtttttcccctcctgagagctggtccggataataccctgcctttgacgcaagccccacctggttcaatacctccataaccctgcgcttcatggttttgtattccgcctccacgacccgctgggcaaatgccacgttttcatataccgtaaaatcagagaaaagccggaaatcctggaataccataccgatatagcgccggtactggtaaatctggcgctccctgaggcctgccagctcaatcccattgacccggatattcccctgggcaggctctgtttcctttaaaataagctccagcagcgtggtctttcccgcgccgctgtctccctccagaaacaccagctcccccctgtcaaccttcaggctcacattatccagggccttttgcccgtttccgtatattttagtaaccctgtcaaagaaaatcatactgttgtccactgcaaacctcttttccgggaaatttatccacaatcacatatccttattctgaagcttataaacaaaggcaagtatcttggccacggtctgataatattcctctggaatctccatatctacgtccaccgtatcatacaatcctctggccagaggcctgtcctccatgatatacacaccgctggcctccgccacctccactatcttaagggccagatggtccgcgcccttggccagcacaaccggcgccctgtttttcccggaatcataccccagggccacagcgtagtgggttgggttacggattaccacatctgcattgggaacattctgcatcatacgcctggacgccatctggcgctgcttctcacgtattttccctttaatctgcgggtcgccttccgtctgtttgtactcttcctttatctcctgtttgctcatgcgcaggttcttctcatactcccaccattgatagagatagtccacggctcccagaaatacaaaggcaattcccactgtgtccaccagggaaaccactgtattccccacataaatgagggcggatgcaactgttccctccatcagtcccgtcagctccgccagcctgccctttaaaaagaaccataccacccatcccagcaccgtaatcttaataagggactttaacagttcaatgacagacctcagggaaaacatacgcttaaatcccttcagggggctgattctgtcaaacttgaattttagcacatcccacgaaaatgccatcctggtctggaaaaaggtgactatgaccgccaccagaacgccgataaaaagcaggggcagggacgccttaaagaacaccagcacggccttcatgaacagtcccttccccccttcctgccagaacacatccggcgatgaggcatatgaaaaaaacaagtgtatacactccccaaagctctcatacatcataggcgccagggcctttagggaatggaacaggaccagcagcgagcacacagcggccacatcgctgctctggaacacatttccctttttgcgttcgtcctgccgccgctttggcgtggctttctcggtcttttcctcagcagccacctgtcaccacttcctctccctgtatattaaacatccggttatctgcagcgcccggcatctgcggcatcccgtcacccgaacatcagcagcagcttctgcgcctctgtcatcatggcctctatatagcggtccataaatgcgcccatgggataggcaaacagcatcatcagcagaattcccagcagaatcttgcactgtatgttgatgacaaacacatgaatctggggaatcagcttcataagcacccccatggtcatctccaggatgaactccgccgccacaaagggaagaaccagctttatcaccatgaggaatacggaaccaaacagggttatgatataccacagaatacgtcctcccattatagcccctgctcccaccggcaccacctggtagctgtaggcaaagagccgcaccatggtcagatggcagccagacgcaaaaaaataaagataaaaaaacacgttgacaaactggcccagaatagcagtctggactccgcctgccgggtccatgacctttcccatggccagtccgaacaccgtgtccagaaagtctcctgccacatagagcatataaaaaaacatgtgaaacacacagccaatcaccagccccagtatcacttcccttatcagggcctccaccatatcaaaggtgttaaaggccatgacatgacctgccccgtttctgactccgggcgcaataagaaggctgagggccagcaccaggccggtccgcaccatgggcggaacgcctttgcgtgaaaacacgggattgataaaaaccagtccccccattctcgcaaagaccaaaagaaaaatgtcaaaatactcaaatataccgctgtccataccacaccactctcatcaaagagctgccataatggcaaacagctccaccacaaactcattcatgaccttgctcatccaggaccctagggctaacagcaccagggcaatgacaatcagcttgggtacgaacgtaagagtctgctcatgaatctgggtggctgcctggaatatggccaccagaagccccaccgctatgcttataatgagaagggggcctgcgatttcaaatgcaaccagcatggcctccttcatgatttccattacctgttcagcgctcatatcttttcctcctcagaatgtaatcagagtgtcatcccagactgtcaccggaagctctggaccagggtcttaatcaccaggctccacccatccaccagcacaaacatcataattttaaagggaagtgcaatcatggtaggcggcagcataaccattcccatggacatcagtgtgctggacacaaccaggtcgataatcagaaagggaataaatataaggaatcccatggtaaatgccttgttcagctcactgaggataaaggaaggcacaatggtggtaagacccagcttcatatatccctcctgtccctgggatacatccggcggctgggttttggatatggacaggaaaaggtccagactctttttctcagtctgtttcagcatgaattccttcatgggctcctgggcccgctcaaaggcctcctcccttgtaatccggccttcccggtatggctggtaggcctgggtattcacagaggcaataacagggctcatgataaacagggtcagaaacaaggcaagccctaccaggatttggttgggcggcgactgctgtgtgcccagagcattgcgcagaaaagacagcacaatcacaatcctggtaaagcttgtcatcatgataatcagggacgggaccacagccaggaacaggaataggaacatgatgtccagcatatccatgggtttgcctgtgccggaagctccctgcagggtcagggatacatccgttgcataagatgtgacagcgcccggcgcccacatacagaccagcgcccctgctcctatgattctccctgtctttcgcagtatcttactcatgattcttttctcctgcctttttctcctgcctgtccttctgtcccttttcctggaaatgccccttcatctgggatgacagaagggaaataaaatcaggcggtgtttccgctgcccccttcttatcataggactccagctcttctattttggatatcccgccaggggttatccccatcaggaaaatccgctcctgcacctttaccaccagcagataggcatcacggcccagggccatctggtccagaatctccattcccccggtcctctgggcccgtcccattccccggcccagcatcctggtggtgtaataggccagtaccagcaccgcaataaggacaacaaggtaaaacagtatttttaaaaatgccatattattccctcttgcccatgacctcggtgatacgcgccccgaaatgctccccggtcaccagcacatcgcctctgccaatcagctcgccattgacaaccacatcagccggggagccagcctgcttatccagcaccagcacctgtccctccttaagggaaagcacgtcctttacactgcacaccgtgctgccaagccgtactgatacatccagcgtgatatccagcagcttctttttgtcttcccctatctgttctttggaatattcaatgggcgtgtacttaaactccggaaacgacacctcctggacagcaatggcctccttatgctccgccatctgtattcccgtctcctgttcaggcatatcggccatatccggtatccccatgacctgtttcagcgcctggtcggcaatgatatatgcatctgattccacaacaccgtcaatgacatagtggaggcccattaaaagtacggaatcctcggccctccagctgcggataatatcctgaatcctctccgtattgtcaaaggccgatatcctggttatggaatcccgcatatccctgcccaggaaatcgttgagctcatccatggccgcgcccacacattgggaggcaacctcccttaaggtgctcagggcaatctcatccaacgggctcagggtatccaccggtacccccatgatatagttggtaagccttatcatatcttcctttgcaaatatgtacagctggtccgcagacattcccctgaccgccttccggctctctatgaccacattaaaatgaggcaggctctccgccagggcgcctgtgtccgtttcctccacattggacaccgacatcttcacacttctgcccagaagggagcccagtatattgcatataggaaccgcctccatctccgtcagttccttgatggcttctttgtccattgataacatgccttttcctcccggctacaattcactgctgatttccacggccttgcgcatctttgtctggcccgccctggcctcaaaacaggccacatcctccacatacagggacacggcactgtcaacctttttattaaggggaatcacatcccccggagcgagctgcagtatgtcctgggcatccagggtaaattcatgaaggatggccctcagctccacctcggattccagcaggtgctgttcaatatagctccgtttggatttctgtttgtcctcatccagtttcttatgactgaccgcaaaggaatagccgaacttggaagtgagctcctccacattaggagcaggcatcaccatattgagtctggccctcagcttctcaatcaccacctccagctccacctggatgaccacatcctcctgggcgctcatctgaagcaggtggggattggtctgaagcccggtcagggacgcctcaatgtccaggtactgtccccaggcttcccctataaattcggtgattttctgcaggacgtactgtaaaatggccttttcaatgtccgtaaaatcccttgacaaatcatactccgacccaactccgcctaaaagcctctcaatcataaaaaacgccagcctggtatccacttccatggtcagaggcgcctcattgtaatccttatttgccggactcatggtaatcattccgaaaagggaatggtcctgcacagagctgctgaattcctggtaacgcttctccacaatactgttgatattaatctcacagaaagactggagaagacctgtgagatacggcgcaagggcacgggcaaagctgtcgtacagattttccaccgtgctcatgcgttcctttgtaaatttctttggtgatttaaaatcgtagctcttaatcactggctgttccttcctgcatcatagtctcatccccgggcatggtcaccgggaacagggggtccattgtctccattccttcggccgtatccggcggcttatatccatttccaagaataatcatatccacccgccggttctgctcacggccttccctggttgtattatccgcaatgggataatattttccatagcctcggcaaatcagcttcctgggattgattcccacctgttcctccagataaatggccacattatccgccctctctgaagacagaagcctgtcgttaatcagggagtttgcggcctgggccgtgtgtccgtttatgtagatagcaaggatattgtcctgcttttccttaagcataattccgactgcatccagcatggatttgctggcgtctgtcagatacgcattgtcaggtgcaaataacaaatcattcttaaaacggatgtacactgcgttctcactgttgctgacaaccgcgtccagattctcggagtcaaaataagtctgtatatccctggccatgtcagccatttccctggctgatgcctggtattgctgcgatgtctggtactgctgcgacggcaccgccgcatcttccggcgcttctgcgccttcccctacaaccggatatttcaaatccgagggcacatcctcaattttagtctttgcctcgattcccagctgcctctgcatggcagatgcaacctcctccagcttggtcaggtttacatttgatatgctgtataataatacgaaaaaggtcaggacaagggttatcatatccgcgtaggtatttaaccactcctggcctccttcttcatccttctgccttttcatttatttaccaatctccagtgcttttaaagccatgctttttgcaacattaagggccgtgacgtttgcctcataggcgcgggtggcggccatcaggtccaccatctcctctgcactgtttacattgggcatcatcacatatccatcctcatcggcatccggatggtccgggtcatagaccggtaccggaggattctggctctccaccacttcctccacaaatacgccgccattctccgccttagtcatggctttgcccagctcattcttaaagctcagggcattctccctgaacactacctgctttctcctgtagggaccgccctcagctgtcctggtggtgttctggtttgccaggttctgcatgatgatatccgtacggaaccgctctgctgtcagcgcggaacctgttatattaagagaatccaaataccccatatctgtctcctttatttgcctgtgttgttaatgacataccgcagggtggacagcctgcctgacacgcgccccgtgagggctgcatactgtgtataggccttccacagctccagttcttccttttccacctggacattattgccgtccggcctggcctgggtggttccgtcttcctccaccacgggctttgcaatccgctctgtcccctgggcagtctcgcggaatacatccctgaactccactttcttggccttatatccaggtgtttccacattggcaatgttgtggctggcaatctgctgcttcagccacatgccatccatccctctctccagggctcccaaggccctgtcatcaaataacggcatgttttgcctccttatctctcatcagcccgtatggcctatgcgtacctgcttgtctgcctgggcaaatgcttccttcagttccgttatcatggggagaatctcctgtaccgtgtccggactcttcctcacattggcctgaataatctggtaattaaaatactcatagagagaagacagtcccttggaaaccggatactgctggtccagcgtggatgccagatgactgataatggcctgagccttcttaaaatgggtattggtcgcttcatagtcccctgtctccagtcccagaaggcccttgttcagacagttgattgtctcatcgaacaaaaggttaatcatatctccctgggtcatggtcattatggactgctgcttatattttgcatatggattctgcatagtgattactccttcatcatgatgagaactgctgggtaagccaggaactctggctgttcatattcgatatagcctgctccatggcattaaactgattccagtaccgggtcttttccagctgatacttggtattcaggttggaaagtgtctctgaaatgtgcttcatctcctcatagagggtattgctggtggtaagtacgtcctttgtgcctgcgtagcgcaccatggttccggggcttccgctgctgacattggcagcctccttaagggcattctgcatgccgactcccagcccctggtccctgtccgtaaacagcgtgcatatggcatccgcattggtggcaaccatggatttaagaacatcctcatcaatgaccagcttaccgttgtccctccagttatcggatgtctcgataccgatatcataaagtgacagccccgcgccctccacactgctgtaaagaaccattctcatatcgcccagaaagctggtgatgttggcgtcattgtgaagaagtccctccttggatttttcttcccagagttcaatctccttgtcgctcatttccttcttctggtcgtctgtgagaggcgcatattttttgtagtttgcagtctctttcagatgtgcattcagttcttccacaagtgtgttgtaatcttctacaaaactcttcaaactgtctactattttatcagtatcacgggacgtagtcaagcttattggagcaccagtatcatgatactccgaggttaattccatggtaattccatccagctcaaaggtatttgtattccgttcaatgacagtgccgtctacggtcagtacggcgttctggccggcggttacgtcggcggtcatttgcgacgaaaatgtaattccatcctgcccaaacagactgttcatgagggcttttccgtttgtatccgttccttccatggtaaatccctttgatgtgccttgtatctgtattttaccatccgatgtatagcttactgttacaccagccccggctttgttctgaatctctgctgctaaatccgcaaagtttttaggaatacttaaattgtttacattaatctcctgtgaagttccatcttccagagttaactttaatttgccttttaaaataccagtatcatttactacattggatgttactgttttaatgttgggaacactctgaattgatttctttccgaacattatttctaccggattcttttttattatattgccatccgggtcggttatatcaccttccactccctcaattttcacattcccggtcagccccgttatattaaaccggccatccttatactctaccttagcatttcccccaatggccgcctgcagccggttcgccaccgtttccaatgtagtactgccagttatagaaacctcagtcccattgacctttatttttccagccatacccgcggcatcccaagtggtatccttgccaaggacattcgtctctcctccggcaaacccaaacacatctgctccgccgttcgttacattatcggatgtaaacgaaaccgcgtgttcggaagactgcactgtcacgtaattcattcctgcattgtcagggtcttccttcagagaaaagttcaccttaccgccgccaaattctctggaaagcttggaattaaccgcgtcaatgacagcctgtgcattcttataatttccaacgccgttttttccttccagttttacagtgaaatctgctccgtccacctggaacgtaagggactggtcccttccgctgttgagattatttactatagcatcaaaatccacggaagttccgctggtaatctcctgcgaaaacagagacgactggacacctgttgcctccacgccaaacatggtggtcagcagattcccataggtctgggacatggttatattggatatctctccggttgaagatgattccataataaacttgtcagccgctgaagaataggatacccgtacccctgcatcgctgctgttgatggcgctgattacatcgctgagcgtggaatccccggtcagtccttttatggtcacgccgttaatctggaattcataccggtttccctcaagaggggtggcaaaattcatattttttaaggatgtaccgtaatccagcttgttggaaaacccgccggaaaatcccaggtttgcaatcgtgtcattgctgctgcccgccgtctctatgataacccttctggaggaatcaattgcattacttgtggcattcccgtttccgtccagcttcaccagcttcataacatttatgctggtgccgtctgcgtccgttccggccaccaggtccattcccaccgatgttccgaaattccggtataatgcctggtttatattatcaagagtatcctgctctgttgccccttttgtaaatgttataatcctgtttacgccgtccaaagtaatggaaaaggagttctcgccctctgccaatgccgacagatttgcttcctgtcctttgggctcccctgtcacggtccctgacgatttgaccgtgcaggcctttgccagctgtgaaatctcactgatattcatggagctgaccgcattggacgagacggagcttatcttaacggcgccggagctgctgataccggtcatggtcttaaacaggctctggctcataagattggtctggcccgaaccgtaataagaaaaatatttatcgctgaaggtattgattttcgttatcaggtccctgtagatatcctgtttccattcaagctgctgctttaatcctgactgtttatcaattttagtctgggtacccatcagaagactctggacaatactttccgtatccatgccggaggcaagacctgatacataattcttgttgccgttaccgctgaccgtattgattgatgacattgtttgtccccctatctccgtttatcatagagcacccctttgctcccctgacccatctgtttcaggtaaccggtaaatttaccgcttacattattcttccttatcttttcctggagctgttcctgaatcactgtcattttcattgggattctggcctccagttcccggattctggtcatgatggcaaatacctcctgcccgtccctgaacactccctgctccgtcccggtaagtccggcgtaatcgcactggttccgtccaatgctgtagcagtatgcgccgtaatccgatgcatccctgatggcagccattctctggtccagtccgtctattttacctatgagggactgccgcgccttcaccgcatcaacaatatcatccacagcatccagggcatccgtatccagcctcagggtttcctgctcatactgtccgaacagaatggccttttccctgagcagcatccgcatctgctcaagcacttccatgtttctcctcctttatgtccgccccagtctcctgggcaagagctttcagatttctggagagctggaataccttaagcaggtccaccttatcagatgcctccttgttattctccatggtaagatacagctcagtgcggcatatcttcatatcgccgggagctgaaatgcccagacgcaccttgtcgcctttaatctccgccacaaatatctcaatatcatcgccaattttaattgattcgccctttttcctggataaaatcagcataggccgtccctctctccctggctgaatatggactgccgtataggataatcctggtccagtattacctggacagccagattcgtcttatggttaatgatgatgggacttttcaggtttaccgtggaattgcggaatgtctctccaatgaccatgagaacccagcagtccaaatcatcctcaggcactgcctgcagaaggattaggatatcctgcatcaccaccggggcataatcgcgttttacctccagaggattcagcataataaagcatatattcttctgctcaatggactgcagccagcagattccatttcccatgttggaatcatttacaagtacaaactgcgtatattcttcaaacccgaatataggctgtttaaatgttataatatttctttcttctatttcaaggattccgaaatcccgcgtctctatcttcaagtaaatccccctatctcatccctgatgccaatcatcctgcctggctactgcgccccttcattgacggccggattggcgctgggcggtacatacatgggttcacccatatactctatctccaccttgggatactgctccacatttacgctgagctcacccggcacatacctggcagacggctcctgtacctgaggttcaaactcaacctgggcaggggtaaagtcaacggataaatcagcaggctcccatgaaatatccggacccaccgatggaataaacgcaattccagtggtgatgttggcctgagccatcatctggttctttatgatgccggaaaccgtcgccccatcctgaatctgcatcatctggttgcccaccctggaatactgggcagtggcatccgatgcagctttaaggccggcgctggcagcatccctcattagtcctctggctgtcttgaatcccaggctgtccctggaacgggacgtatcaatatctaccttgatatgctcggacttcatattcagcttaccaggattctggatgattcccacctccgggtccggcagcctgctctcaagcctggcccgctgggacgtcatggacaacttaatgggggtagacgtaatttttaggacattcatcttcagacacctcttttcaacttatttcataaagtcaaatatggacggcggtatgatgctggaccccagctgaagggtaatcatccaggctgtctcataggatttgttgttaacggcctctgtctcaatcttaactgcctccaggtccgtctggctcttctgcagattgataagacctgtttccaggcggtcctccgtgcggtccagaagcttttctcttgttcccagttcagatgtggcaatggaaatattgctctgctttttcttaagctgtgacagggtatccatggctccgtccttgtcaccgccccttagctgctcctccaccttgccaatgaggctgtacagattattgggaaggccattttcatccctgccatatcccagcacatccacgccggatgtggaaatcttgattcctgtctttgccgtgttcattcccgatgcatatgtaccgaatccgatatccagataaacaggtttattttcatcaaaatatgtatccggattatccttatcataggcgtccaccagtttcccgttgaacatcagatttccatctgaatccacagtgaacggagcttcgctgttggatgaaccggaaaacaggaacttatccccgtaccgggcattcatggtctggagaatctcttccttaaggccgcctaattcctctgcaatggcatccatggaatcctggctgctggctccccctgccttggtggccttttcatagaccgtctcaagaatggagttgagcgtaataatattggaatccgctgtctccagctctccccttgcattcttcaccacactgatatgttcctcggacctggcaatctggtccctgatggcaaatgcctttgacgcggtcgccgggtcctccgacacatgattatattgacgcctagatgacagcttcaggttggaggacgccaaatcagatatattcctctggagattcctgttataggtagctgtcatcatattttccgtgattctcatatgcccctccttaacgccctactatgcccatcttattgataatcatgtccagctgctcatccattgtagtcatgagtcttcccagagcctggtatgctttgttgtatgtcatcatgctgattccctcttcattcagggaaaccccggacacgcccatgcgctccgaatccacgctttccgcaatggccagggaagcgctcatcctggcgctgtttgtcttgattccgcttcccagcgtattggtgacgctggatataaattcactgaaggttcccgtgtattcaccgccaaagttaaaatcctgctccaatgcagccttcatatcaaggatatcctgattgtccagctctccgtcgggattctgtttccggataatataggaaacatcgtcggcccacaggtcgctgatgcagatatttcccgctgtcactgttccgttggaatctccctggagaagaaacttgtatttatccgggaaatcagggtcatcggcatgaatcttattgttaaacacatccgccagtgtctgcgcgaaatggttcatctggttctggtagtaaggtatccctgcattgatttggtccgcgccggtcagcatatccgtaaaccctctgatggctccctctcccagactggccttctggttgctgctgttccatgtgagagtgacgccgtcgctgccaatgttaatcttatcattggtgtaggaagccccggaagcgtccaccaccacctttccattgattttcacctgaatctttccatcatccaggtcggttacctggacatcgccgtaccgtgacaggtcatccagtatgacattcctctggtccagcaggtcattgggcccgtagttgactccgtcatagtcgttgttgctgaatatctcatgggcaatggaacggttcagctcagacagctggtctaattttgtgttgatatccgtcaccgcagccgacaaatcattctttgtctgttccatcagggtgtttagattggcgtcatattcattgagcacctgggtcacgcctttaaacgcattcatgacaatattggcattggtctcctggtacggggaggcgctgaaatccgccagtgcctgggacagggtgttcagagccgccttgatgccggttccctctacctcagggtcactgataattccctcaatctggtccataatggctgccttctggtcataataccccacgtcgccgtactgctgcctgaacttggcatccagatacggattgcgaatctgcgccactcccttgacatccacgccctgtccggccaggggaatggagctgtaattatactggtcgcttccgtaggtatggacactcaccgaatccagacgctgtcttgtatatccctttgttttagcattgcttatattattgcctacaatatctatggccttctgattaacctgaatccctcgtttggctgtctccagccccataaatgtcggtctcaatttaccactctcctatataggccctcatcaggcctttttttccagtttactgcccttattgaatgcaggacgtccatagatgccggtgggatttcccacatatctggaatcaactcccatctgctccagctcagacttggctaacgcctctgccttctggttgtaatactgtatatttcctatggctccgtcaattctccggtacaggtccataagctcctttttctgctccggccctgcaacctctgcaatttcttttaaggtcctgccctcaaacccgcaggagacaaacagcttctgacgtttctgctccatgttctccagcttcttatccatggcctgctgcatcatgatggtctgctcaaccttatccagctccctggtcatcaaaagccctaatttctcaatctgcttctgttccatggcctccagtgtttctgtgtattcccccaaaaaatcaatgatttcttccaatatgttccctcctacaggccgctcataaggcgtctggcaatctgctccgccgatacctggtatgtcccctcctgcacctgttcccttaacgcggcaatccggtcagccggagccccttcttccatggaccttgacagtgcggctgaaaatgaggatgcaccgcttttttttgcgccctcgctgctgatgcagatagcatcaccccttgcctttccggctgcctgtacgggagcagaaaggcttttttccgtatgttttgcattgctcactgccttctgataggctgcgtaatttctcgatacttttatatccatatgtccggcttcctttccctgcatgctctttgtatggtgggcctgataagtggttgtgatatttctatagtacttatcgtacagggaagataaaactttatagttcttcaggttatttttatatttattttgcatgattgggacctttttatctttttcagaaacaaaaaacagataacaaaaaaccgttatagggggaaatcctgggattttgcctcttaacggttgatggggttgttttatattggtccggtcctctgtatatctgactgtctacaggctgtctcagtgccacggggccttctttaccaccaggatagcctgtacaagcgccccggttacttcggacccattttccagctccgccttcctgcgcttttcctgttccccttccttcatcaccacgtaccgcggtttcagacggttaagggccagtgctgctatatcctttttacacttatcacatttacagcagttaaaccggtccagggtggagtccagcttgtttatcaccagttcctccataaggtttaccagtaccatattattttcttctttaaacggaaatgttaccgggttacgcttaagggtttttgccatggcggccgctgagggcgctgataaagccggcatgcctgcagcagttccgtctccatctgcaccatctgacggcacggcgtctatttgccctgcgcccgggtttcctgtatctccctgcgctgcctttgcatctcttttagaggcagagggcataatcttgcggtacattatttccttgtcaatctctgtcctgctcttagacatctgccttaagccccctttgaatcaattcctgtatcaactttttataatcccggaccgcattgcagtcaggtgcgtattccagcacggaacgctgaagggactgggcttcccgaagcgctacgctgtcccggataaatgtatccagaaccggaaaacccaaatcctccgccaccatacgaagggcgccctccacctctttgctgaattttgtcctgggattgtgctttgtaagaaatacccccagtatctgaatccggggattacagtaatttctgacgcggcatatggtttcatccagctgggtaatgccctgcaggctgaatatatccgaaagcatgggcaccaggacgtaatcagacgcagtgaacgcgttcactgtcagcacgcccagggccggcggggaatctatgagaatgtagtcataggagctcttcagggattccagcgcctcttttaaaaggaactccctgcgcgccccggtaaactccagctcaatcccgctgagcaggatattggacggaattatatccaccagaggggatttctggaccgcatacctgggtttcagctctccttttaacacatcgtaaatggtagcgctctccgtgtccgcccccatggcgaaactcagattgccctgcgggtccatatccaccgcaaggactttatatcccttttctttcagcgctgttgacagcacgtaggctgatgtggttttccccacaccgcccttctgattggacaacacaattgttaccgacatagctactcccccgggaacctgaaggttctctcacattatgttacatattatagcaagaaatgtcgaaacagacaattgtattttactgtatgaaaccataaaacaggattcaaaaaggcgctgcttcatggctgcgtgaccacagccatttggcaacacctttttatcttatctgtttggaactattttaccgttaacctgcccgattaccatacttactataaattactgtaataactgtaatacggactgcggctgctgattggcctgtgcaagcatagcctgtgcagactgaaccagtacgctgttcttggtgtagttcatcatttccttggccatatctacgtcgcggatacgggactctgcggaagtgatgttctcagtggtaacacccaggttgttgatggtgtgctccagacggttctggatagcacccagtttgccgcggctggtggatacggtgttgatggcggttttgattttgctcatggccgcggccgcgccgtctctggtgctgatgtcaacgctgtttaaatcaagggcatttacgtgcatgtcggcaatgcttaattccaactggttgtaagaatcgctggtatcgccaatctggagcttcatgccgccgccagctgcaaggccagtaccggccttaccattttcgcccaacttaagaacattagctgtacctccagacttagcgcctgaaatttctgtaccagttttggcaccttcaaaatccattcttatatccgaaccagcatctgataacattttgttaatttcggtagctgtataagactttgtactagtcaaatttaatgccacatttccatccacatcaacagttgcaccaattgtacccgtagttttcgttgttaaggtatgggtattctcacctgctttagtagatgaaattgaaataccactggcacctgtgtctgcggaagtcgcctgcgcagctttagctgttatcaatgtagcagaccccgaagcgtcagtagtaccggtaatgcttatgtcttcatccaactcaattttaatattctttgcagtttctggagtaccggtagccgcagctaatgcttgattaagctgttcctgagtaattttatcacctgtgtcaccagaaatggtaactgttaactttcctcctgcccaattagccttaacgccagctgcaccagctgccgttttaaaatctacagtggtattttctccagcaccagaaatagtagccttaaattcgtccacgttacctgctgataaatccacttttccactcacaccgctggttccaacacccatagtaccatccaacaacttaatcccattaaaatcagtaccgtcagcaatacggttaatctcatccttcaatgcagaaacttcatcctgcagcgccttacggtccacatcatccgtataagtgccattagcagacttggtagccagctcggtcatacggtttaacatggaatgaacttcctgtaatccgccctcagctgtctgcaccagggaaattgcgtcctgagagttatcggtagctgcttccaggcctttaatctgtgctctcatcttctcagaaatagccagaccagcggcatcgtcgcctgcacggttgattctatagccagatgataacttctccagtgactttgatactgcgctgttgttaacccctaactgcctgttggaattaagtgccataatattgtgctgaatcctcatactaattacctccatgtaattgttttttaccgggacttccctgtccctcgttttttctggttattccaatgaacgacgggccctgtcggacactggaccgagcttccgagacataccatctcttccgctctgtaatatttatcgtacgcccctcccattttatttaccaaaaaagtgcacaaaaatcatcgttgatttttgtgcgccttatccatatagactctgttcaatataaaactcttccagggacaggtcgtggtccttcatgtattttgccgcctccacccccacatagcggtaatgccagggctcatactgaattcccgtgatatccgtcttattctccccataccgcatgacaaaaccgtaatcctgcgcatgttccaccagccatttactctccggtgtatcctcaaaagcccgttccagcttgtggtatcttctggtatagaagtccactgccagtcccagacagtgttcccctgagcccggaatggatatggtctgtctggccagattataggattcctccttggtatgtccgcccttcacataggactggacctttcggttaaacagtttttcctgcttgtccagcgtcctgtagccggaacacaccaccggagacaggccctgggtcttcatatctcctaccatggccatcagcggctcatagattctcctatccactgactgctccgtaccgggaatggcctccagctccacctcataatcttccggcacaggatattccgcattggtaagtatcagacaccacatatcctcctgcgagattctaaggactccggcctggtcccccccacctttttctgcatcattttcactccgcacagctttcccgcttcctgcctcatccccactccctttaacactccccccgcgttcctcccagtcctgcgccgccgtctgttcttcccccgccgccagctcctcccgcaccgccagctccctctccttctgcaccgtcctgtgagccgagatataaaacagggtcaggattaacaggaaggtgtaaaccgccacccgccggttcctgaccacacgctggtccctgggtttcctctgaaccatattccgcgtttcctcctaacatgccgttctctcaaatctaccgtatcctgcgcagctggtccccctgacgcctgaggatataccggtacagcaggtcctcctgctttgtggccatgtccatgaattcacagccatagccatatcccccttccgggcgctccgcccgcctgcgcacttcgcatacaaacagcatggaatcccccatagccggtatgacgatattgaatcggtcattgaccttgaattcctccctggtacagaacatcaggcctcccaggctgatatccaccaggcgcaccttcaggccattgtaatcctcggacccctctcccatgtccagggtttcatttccacgtatacagttatagataattccatcgtcccttgtactgatgcggaaatactcccggcgctcgtcattggtggcctcattgagttccacgattcggaccagcttgggagaggacaggtatacccgtcctatgagtaccttaaatccaagctgtgtattgtatatctccagcttaataattaaattatatggaattcccggcagttcattgcgggagctgcccacatctatgaagttcttgcctatacgatggaggacgcccatgctaatcaagtcgttgttcttggcctttatgacacaggacgaacccacatacccgtccagcaattcaaccatcttccataccccctgttatcatgaagtctgcttactgtcatctttgccgtgtctggataccaggttccggcgcagacggccgggctggctggtttcctctgtttgcccggcagatgcggagactgaaacgcccttttccactccgcgtatctgggcggatgtttctatgagcttgcagtaaatagccgcaaccacttcgtacagctccaccggtatattgcttcccacatccagcatacacagcagggatgccgcgctgtcatccttgaacaccggaatgccttttttttccgcaatatcaataatgtgttctgcaaccgttccataccccgatgcaatcaccaccggggacgtgtcctcatctacgttgtatttcaaagcaactgctttatttttcttatattttgacatctacacccgtccttttaaacggcaggtttttaaatacctccatcagggaccgcacatggtccatgcgctccacctctatgcccgccgccctgtatccgtgttcctccatgatgtttctgaacgcgggaaccagcccttcaaatatgcttatataggattccggacaatacagatggaaccccagctccctacccgccatcatgaattccgcctccatctgacccactcccggcacatcaaaggttataagcacatgtacgtggcttccttcccggctgccgggctccccgttcctgccttcgtcctttgggtctatccacagttcggaaaatgccttcatcccctggtaatccaccggtatcacaaaatgcagaagaggcgtatagttgcagggagaggataaaagacttgtgatgattttttctatcttatccccgttcaggctgttcatgggtgtctccctgtcctgcttggcaatgattttagccagggtatccatgatgcgggaacggttcatctgatgctccggctccctgaaaccggcaatgtattcccttaccagctccctgatatgtgccttttcctccctgtcgttcacatggatgagaaggttcataagggcctcctggaggtaggcgtcattgtcctgatagcgggacatattatacagtatgttgggaatgaccctggccgcctggggcgtgtagagcacgctctgttccagttccttcagggcctgctgcacctggggcttcagctcctcaaattcccggccgccgggactctccctgacacgggcggcaagctgtgaaaacattccggacagattcctgctgccggtcagctgttcggacaggtattccaggctgttggccactgagtccagaacgtcctgtctggatatgcctgcgttcacagcctttaaaagctcggctgtttccatccgcaaatccggcatttcttccagtattccccgcagcaagtcaaacagctcgcccttaaacagggtagaagcgtattcctggtctaccagttcatccacaatgtgttccgggtcaatgagaagggcatcaaatagctggcggatttcctgggtcacggtattgttgttgaccggaagcagattgatgatttcctccagcatatagatatttttcagataattgactgtcacagccgggtccttcagcaggttcataagggtggctgccccggcttccccctccagcacattgtgatggcccaaaaggccgctgcccgacgggttcttggtaatatgcctgatttcctgcatatcaaagggaaccgaagggtcctttaatgccttgtcaggctgtataatgttcttgttgataaccggagaggtcacccgcaggatgtctgccattaccgaattcctttcttgatttccccgtcaagataatagaagacacagctgtcctccttcttggaaatactcatcttacaatccccgatattgattacggttccgggaaatacctccctggccgtaagcctggacttgccaacctccctcagcttcctggaaagctcggcaccctgctgcttcagtttcttttccttcagggtattaataggggcctccagcttcagtttggataagcgttctctctgggagggggttatggtcccctccttcagcttgctgttgagataagagatatctttattaagctccgtcagtttcctggaaagcagaatcatctcctttcccactgcctccatctcatccatgagctggggcgtcagtcccagggtcacggacgtggcgatatggctgggcgctcccactgccttaacattcatgcaattgtaaacagaacagcttccgccgataaatgcccctctttttccaatcaatgtcaaatcatggccgcaggacacctcggaattaatgatatattccgcctggatattatttttggaataaatattacagtcctccagaaacttagccgtgatatcaccctcagcctccagcacgccggtcctcatgccccgcattcctttgtgcagcagaatatcgcctcctgcgctgagacgggcgccttccacgatgcccatcaccgtaatatcgccctttgccctgacgctgtagccctccagaacatcaccatgaataacaacgctgcctgtaaagttaatgtttcccacggaattgtccacattgccggacacagtaaatacattctccacatggaaacggccggaccggaaggtcaggttgccctcgcagccagccagcagcctatccctttcttcggagtacacaatgttttttccctggggaacagggggcatggttccctttttgccgtgtacaggctgtccgtacacatccatgccgtcctccggttcggtgggaagggtaatatcgcagaccacatcccccttcttcacattatgtatcaggttcgtgcttttaaagtcaattcccccattgcccttggaggcgtactttatctgggcttttctggggaaataatccttaatgcggccgtcctccccatttctggcaggctggcccccggcgattataaccatctgcagatactgtttttcaccggcaacaccgcttatcttcttccggtctatgccaaagcatattcctttctgctccagcgcgtcgtatatcatttcctccgttatatcaagcccgcctccggacggcccgtaaaccatcatggataccgacatcctgtcatctgaaaccagaagctccacccttgcatcccggtccgcttcctcttcctccatacttccatcctgagcatcgctgaacccggactggtcctcatcatattgcccggcgtcttccccgccggtttccggactctcctcttccagcagctcccgttccatctgctgccggcgcctctgctcggtttcgttccagtcctccacggtttccaccctgtggtcctggtctctgtcccggcgttctgtctggtccgtgctgtcatagggctgcccctgaggccccgatactctatcctgttcccgttccgggctttcgctgccgtcctcttgccggggcgtctcctcctgcccctcatccaggaacttagaaaacaagctgtatataaggcttttttcgttcatgggcatctcccctttcagtaagttcagcgtacgtcattaccttgtatgtcattaccttaagttattaatcatctcttccatctggtccgcagtcgtgacaatccggctgttgagctggaatgcgcgctgtgtctgcatcagattcaccatctcggttgacatgttggaattggacatctccagggcatggctcacgaccttgctcttctcctgttcatcatccaaatcatctatggacagccattcaccggaggtttctcctgtgcggaacaggttcattcccacatgctgcagcccttccggattctcacacacaaacagtccgatgcggtccgccagtccgtccaggtccagctccccagtatcgctgtctttgctgtcctccgataccttgtactccagctctatgggttccccgtcctggtccagcacatagcttccatcgctggtggtcaggaaattgccgtcatccgtggaggatatctggaacgccccgtccctggtgtaagccggttcttcctcgtcctcactggtctggattgcaaaaaatgcattgcctgttatggcaaaatccagctcccggtccgtcctgcggaaaatcccctgctggaacgtggtccccggcccgtcattgcggaccccgtgtcccacctgcgcctggggacgcatatccatctgcgtgtacagtaaatcattaaaactgctgcgcatggacttatagccgttggtgcttatattggccatgttgttagaagtcacatccaaatccttctggaacgcattcatggctgatactgctgtatagtacgatatattcatctgtggttcccccctacagctttccaatctcgttggctgtcttctgattcatctggtctatgatggtcagggccttgccgcaggactggaatgccctctgcacctccatggccctggtcatttcattgttaagattcactgctgactgttccagctttccctgatacaccgtgggatagacctgagtcagctccacgccgtctcctgccccgtaggtaccgttgtcataaaactccagattgtcgtaattgtccggcgccacaatctgaatctggtccagggcgccgtcctcattatcgtaaatgatgccgtccgcgccaacgcggaatccctcctcatccacatataccggaccgccgtcccccatgagctgccccactccgggcagtataaggtttccctcatcatctctggaaaaatgtccgtttcgggtcagataccggccgttctccccctgtatgacaaagaacccgtcgccgttaatagccaaatcataggtttttccggtatcttcaataggtccctgtccgtgggtggtcatctccctggttccgacggatatggtggacccctggcccagcccctccgtccttccgttcatttcccgcaccagctgctggtcaaaggtggtcttaaccaggcgtttcggtttataaccgctggtctttacattggctatgttattggctgccatgtttaatgacctctggttcatcagcatgccggatgcggctgtgtaaaatcctgaaaacatagttttatcctctcatataatcttccaggctggttttcagcttatggattgccttggtatgtatctggcatacacgggactgtccgatacccatgacctgggcaatctccgaatacttcagttcctcatagtaatatagggtaatgacaagccgttccttttcccccagcccgtctatggctgatgtaagtgtttccatcagctccttgtaaaacaggctttcctctggttttccctctatgccgccggcctccagctccccttttgccactatggccgtcatatcctgcagcacggactcaaaggaaagaaggttggcgtgattcatatatttaatgtgattctctaccttttccacgggtatgtcaagataatccgccacatcgcccacatccggctccctcatctgctcatgggacagaatggaaaatgcttcgtctacctttttctggaaattcctggctctgtgaggcacccagtcctggctgcgaatatagtcaatcatggctcctcttatccgcataaatgcaaatgtttcaaacctggcgccccggtccgaatcataccgttccagacattcaatcagcgccagcacgccctggtctataagctcctcctgttccaggagagagccggccatggaccgcagctgcactgccgcagaacgcacaatgggaagatagtgcacaatcagcctgttcctcaattcctggccgccgctttttctgtagtcgtccagagcacggaccatatcctcactctctgtctgttccatcagcatatcctgttacctctggcttagggaaatgtttcccaatgcctgtatctgtatattgttgtcaatctcactgaacgataccaccgcaacgttggggtaaaactggtcaatgagctttttaaagtaaatccgcaccaccggagaggtgagtacaataggtacattaaccaaatccttaatcttattgatttcagaggtggcggacgacactatgctctgaatggctgttggttccagggccaggtaggagcctgtatccatctttttcacggaagacataatcatattctctatccggtcgtccaggctgatgaccttcatctgccctgcctctgagaaccgccgcgatatggtacgctttaaggcctggcgcacatactcggtgagcatatccgtatccttaacctgactgccgtaatcgcccagggtttctacaatggtctccatatcccggatggggatttcctcccgcagaagattggccaggaccttctggagccctcccaccgatatgacggaagggatggtgtcctccacaatactgctgttggtcttcttaagggcctccagcaggttgttgacctcctgccggtttaacagctcatgcaggtgctccttcaccacctcggacaaatgggtgattaccaccgaagtggggtcaatcagggtataaccggccagctcggcctgtatcttcctgtcctcgcttatccattttgccggtatatggaaggccgggtcaatggtatcgattccaggcacatcgtcagcatccgtgcccggaggcagggccaggtaatggtccatgagtatatcccctcgcgccacttcctcccccttcaggaggatgctgtactggttgggattgagctgcccgctgtccttgattcggacagagggaatcacaaatcccatatcaagggccatctgtttgcggaacatgaccacccggtcaatgaaattcccgccgttgctttcatccgccaggggaatcaggctgtatccgaactccatttcaatctgctccacattcagcaggccgtatacattttcaatattcttatagtaggacgcctcgctggtaacctctgtctccaccagctcctctgctgtctccgccaccaggctcttctgatgccggtacagataatacccgcccccaatcatgcccgctgatataatcagtatctggagaacagggaatcctggtatgaggcacaggcaggccgctgcgccgcccgcggtcatcagcaccctgggctgggccaggaactgctttgtcaggtcctcgctgaggctgttctccgaggcggaccgggtcaccaccataccggtggcaaccgatatgagcagggccggtatctgggacaccagaccgtcgccaatggtggatgtggtatatatctgcatgatatcctgtatgcttccctggctgttcatgattcccaccagaaggccgcccacaaaattgatgaaggtgatgatgatggagataatggcatcgccctttacgaacttggtggcgccgtccatggagccgaagaagtcggcttccctctggattttagaccggcgttcccttgcctgctgttcgtcgataagtccgctgtttaaatcagcgtcaatggccatctgcttgcccggcattgcatccagggtaaaccttgcagcaacctcagccacacgctcagagccctttgtgatgacgataaactgaaccagcacaataatcaggaaaataataaaaccaatgaccgcgtttccgcggatgacaaactgtccaaaggtcttaaccacctgtcccgcgtatccattgtcaaacaggatttttcttgtggatgatatgtttagtcccagcctgaacagggttgtaatcagcagcagggaggggaacacggaaaactccagtgtttccctgatatacatggacatcacaagaatcagcaaagacagggatatgttcagtataaataaaaagtccagtataggcgtgggcaggggaatcagtatgaggaatataattccgatgattcccgctgttacaaggatattaaaccgtttcaactttattcaccatttccaataatgcttctcgtatttactatttcactgatacgcaccccaaagttatcatcaatcacaaccacttccccccgcgcaatgagctggccgttgacaatgatgtccaccggggcgtccgactgcttatccagctccaccacggtgccgttgctgaaattcaggacatcctttaggcggcgtcttgtcttgcctatttccacggacacgtttaagggcacatccatgataaggctcaggtttccgctcatggacgggttttgcagcgctctgccctgcattcccgggaacctgccgccggaaacattgccccggacagtgcctgaacctgctgtctgggcccctgtctctccgggcctgagcctcccgcctcctgcccctgccggccgctcctgtcctatgatggaatcctgctccatcaggagggcctgcttgcgggcctcctcttcttccaggcgggctttttcaaaggccgctctccgggcctgtatttcctctgtcaggctgtccatggcagtggatgatatacattctataaactctgattccaccatatccttaatcttcatgatgtagctcaccaccatgactcttgcatccggctgctccccgatgaccgaagccaggtcctggctcccgtctgagagcaccagctggcagtccgacaaatccatggtgtcgcccagatattcagccatggacgaggcggatgcatgggacatctggttcatcagctcgcctgcagcgctcatggccacatcgtcaaagacaaagtccgggtccggaaggtcgtccacgcccataagttcatttaagaatacctgcatatccctctggcgcagaaccaggacaatattgcctgccacctgggaggtcagacagttctttacaaagatggcaggttccaggataccgtactccacatccttgattgtcatatcctgaagcctgggctcacctatgcctatgtccgccctcaggatggaagagatggcctcccctgctgactgtgcatgtattttaatcagttcttcaaacatctgcctgtctgtcattgcgctgacatcctggcctccctctgcctttgccatggtttaagctccttctattcctcaatctctttcttgttctttttgcggcgtcttccaaagccctttcttttcccgtccttttttccgtcctggttcccgtcctgtttctgttccttttccccaggcttcttatagctggccggaagaagcttatagagcttttcctctatgaactttgggttttccccctcctggatggccaggactccctccatgaccagctgtttgcacaggaattcctcgtcatggcgggccttcagcttgcttgccatgggaaggcataccacattggccagcagcgaaccgtacagggtggtaataagcgccactgccatgccctttgccagggcatccacatccgacatgtttcccagcatgagaatcagtccgaccagcgtgccaatcatgccaaaggcaggcgcgtagctggctgccttttcataaaaccgccggtccagggcatggcgctcatccagctgttccagctctgtctccatggccttgcgcaccttctccgagtccacggaatccaccaccagcatcaggctgttatgcagaaacggctcgtcaatctcacttagcttgtcctccagggacagaagccccttcatgcgggcctctgtggccagattcacaatctgttccactgaatccgcgggactgtactggtagggcctgacaatgattttcagatggcttccaatcttcctgaaggcccctgccgggaatgatatcatcatgaccccgatggttcctccgatggtaatggccatactgggaacatccaggaacgccttgaggttatgatacacaatcctcatggactcctggtcaaatgtcataccaaacatcaccagtccaactgctaatataaaacctaaaattgacaagacatccatacccttacatccttttcctcaacttttatcttgctgcatcagcccttaatctgttccagtatgccccggaaggcatccctgcggaactccaccacttttttgaccacgtcttccttggactccctgacaatcagatgctttccgttggtcagaagtatggtggtatcaggggtctccataatggtttcaatcaggtcgctgtttaacacaaactcttcgccgttcagctttttcaggataatcatgataccaccctcccatcactttatctcttaaggttcaccagttcctccaggatggaatccgaaaccgtaatgattctggagttagcctggaaacctctctgtgtgacaatcatatctgcaaattccgtggagatatccacattggacatttccagggatgaggtttttaatgctcctgtgccgttctctcctgcctggcacagctttgggtcgccggagttagccgtggtcttgaagtaggagttgcccacgccctccagaccataggggttatcaaaggtaaccaaatcaatgcgtcctatctgaatcttgcccaaatcagggtgcgttgcttcgatgattccattggaaagaatcgtcactcccacgccggacagggccacatccccgccctcgctgccgtttgtcagggtaaagttcttgctcttcagacctaaatcgttggagttggttgcggctgtgatagtacccacatctgtctttatcagcgcattgcccgtaaggtccttgcatgcatcctggatagcggcatagcccggatgcttcagctcaatatactggccgggctggtcgttcaggggcacggaagaatcctcctctttcagccacacgctgttagccgaggtgctgttctcgctgacctggcctgtgaaatatcgtttcgttccgtcgtcattctcaaccgtggccttgataatccatgcggcaggctcggttgcagtggctggctggaaggtcatctcatagctcaccttgcctgaggcagtaaatttgggctctgtgctggtaccggagggtttgattcctccgaatatgccgtccttgatgtctgtcgcattggtaaaggtctgtacgcctgacttgattccgaaattctcacccagcaattcttctcctgtaaggctggtcttgaatatcttgtccgcgggaaccgctgttatggtgaaatcgcctgccggatgggcctttccgctgttggcccgtgtgatggcggcgttcatcttgctgttaaaatcagctaaacttgtaaaaaccgcatttttgtttacgctgaccgttatactggaatcctttaaatcccctgattttaccaccacatccgctccgtccggaagcgtgtcgtccagccggaatgagatggtgacattggctgcgccggtggtgttctgggatgttatggtatattcaatcccattgatagtctgggagttagttgactgtgcattgttcttgccgggtatgcttaaatgtattttgtctgccccggcagccttgccaagagggtcccctgtaacgcctagcaccgtgtatccgttggcatccaccagattgccgctgttgttgtccagctgcaggtttccggccctggtatagaatatgtttccgtccgagtccatcacctggaaaaatccctctcctgtgatggcaacatccatgggcctgcctgtggactgcagggccgaccgtcccatattcaggtcaacgcctgccagctgcgcgccgtagcccacctggctggcattggttccgcccttattgttgtcaccgcctgtggcgctctgcagtgtctggtaatatacgtcctgaaaacgggcccggcttgacttaaagccgtatgtattaacgttggcaatattgttgccgataacatctagctttgtctggtgggcctgcataccggacacagctgaaaataatgaccttaacatgttgaattctccttttctaaccgccctacccgtccgtcattcggggtaaggatagcctcccaaaggaccggctatatcattacggttccgtcgatattcgtgaaaacagtgcctttcaggctgtcttcattcacaacagtgactactttattattctttacatttacaacaaatgcagtggttcccaggagaatcagaggttccttcagtcccttttcctctgccatgcgcactccctcattcaggcggtccagcttttcagaggaaacatccacgccccgttccaccacacgctccatggcatgtctggaaaaggatacctggctttcttccttcagtctctgctccagcagttccttaaatgcattgtcgtttcccgtttcccggggcctgctcttcggcggctcacccggagtccccgtatagatgggggtatgaagcattttattataaatcatggaatccattgttcatcctccagtcccttgctgcggttcatgaaacatctgctcataaaaatggttatcatgccgtgccgccggatggtgttttttcatctggcgcagtttggccgtcaggcggggtttcatcatttccaccggattcttctgctgcgggcttatccttgatttccatgatttcatccatggaaaaggcttccccgtccacatatattacgaatttcccatccagcagggatatcttctccaccactccgtctgcttttttcaggtcccccgacacggtgaacttagctgcggacacattcttgcccaccagggaagccacataggaactctttgcattgtatgccatttcctccatctgctgcatggtggatatctgggccagctgggtcacatactgggtgtcatccaccggattcataaaatcctggttcttcagctgcgccaccatcagggtgaggaaatcatccatgctgactttcttgtcgtcctcgcttccgaagacagcgtcaatcacattgccggaactgtctgtactgtttgtactgtctgttccccctgtccccgtatcattgtcgtcggacagccccctggctttggctgaatctgttccctgtaatcctgatttggaaccggctcccggcccggcggcacctgcgcctgatgtataaggcgtactgtaatctgactgtatgggcattgttctctcctattctgtaagcggcctaaacgtaggcgtatagcctgctcatgcggctctctgccatcatccgctctgcttccgtcagaagttcatcctctaatccgctgtcctctgttccgtgatagctgtatccgaaatgggcctgccggccctggcgctgcggcatatgctggctgaatcccgaaaaatccatggcattctggctgctgtggtaaacttcctgtacttctgtgtttaagggcctcagcatttccttaaggctctccatctggctggtaaccagcttttctgtctccggatttgtgaccccgattcgtaccgtcatcttctccccggcgcttgtcaggcgtaccactatatctcccagtccttccggttttaaatggatggtaagttccccgccgtctgtcttcacagcccgttcaaacccagtcttaagctgttccagcacaggagtctccatctgctgttccctggcgtccggcaccggccttaggctgtcattcaccctattctgcactgtcttcccggtcaggtcaagccccctggcatccgcattccgtttcagttcctccagagcctggttcacatccccgggttcttcatccgctgtcccggcctgttcccgcagcagattaaaagccttattctgcctgcctgccataccggaaaacatatcttcaccggatggctgtgtctccttgtggttccggaccggggcctccatttctgcttccatggcatctgtccttgaaagacggacaaaatctgaggtcctgtctgctgtctcctgtctgacctcgggcctggacactgcttcctgagccgtctgccctctggccgcttccgcggtttccggctgaaccacctcccggaacggattagctgcctgctgcccgtaaccctccggattcgtgttgattaaaagaggctgtcctgtctttcctgtttccggggaaaattccgtctgcatgacagcatcctggatatccggcgctttcccgtccccagtgaggaccggcacttcctgcagcaatggcatcattgcctgaaggctcatggctgcttccgtgatggctgcttccgtcatggcgctgttattctggctttttccgggctggctgtcctgttccgcgttatccgtatgctctgtctctgaatctgccgtcttactgccgccccggcatgtgctctcttcagaggtcccggattgtttggcccggtccgcagacatggggttctttcctttatctgctgtatcccgtgcttttgaatcagccgcctcattccatttcctgcctgccgcctttgtgccgtctctgcgggcatcttttaaattctgtgcaaacacatccatgaaactggcggcatcctcctgtttttccctggcccctgagccaacggatggattctccttaaaacggctggctgtgagagcctgtgtaaatgttcctgcgttcatctgtttcacctcctttcgcagataatgttctatttaggaaacgccattcctgacaaatgctccggcaacatgctcaataatcaggtcctgctgctcctttgcctcgtcatggcggtattcctccaactgtttttccttcagcttctccagcttctttacctcctgggaagcttctgtcacaatgcgtctctgcttctccaccctggcctgcgcccgggccagctctgtctctatttcttccagctggattctggtgccttccaggatggaatagcagcccttcaggataaatacggttgtcccctgcatctggcgctgtccgatatcctcctggatatgatggattttcagctccttatcccgtttgtcttcctccagcctatcccgttcagccgtaaccctgcccagaacgcctttttccttttccaggttctgttcctggtacgccagcatgcgctccagcgtaaatacaaactttttcatggcccgccccttaatccgttgcctgtatcatctggattactgcctcatccagggaaaagctctcatccgtcttctgctggagatatccgtaaatacggtcgattcgttccagcgcatcatctaattccggatttgtccccttcttataggctccgatggaaaccaaatcactgttgctctcatatacagccagaagcctgcggagctttccggcagccgctttatgttccggcgtcacaatgtcattcataagacggctgacactggacaatatatcaatggccggataacggttcttggcagccaccttccgggacagcatgatgtgtccgtctataattccgcggaccgtatcggatatgggctcgttggcatcgtccccctctaccaggaccgtatagatgccggtaatggaaccttcctcaaaattgccggaacgctccagcagcttaggcagctctgaataaatggaaggggtataccccctggctaccggcggctccccaatgctcagccccacctccctctgggccattgcaaacctggtaagggaatccatcatgagaagcacatccatgccctggtccttaaaatactctgcaatggtggtggctgtcatggtgcacttggaacgcatcatggcggactggttggaggttgccaccaccagaaccgaacgtctgagcccttcctctcccaaatccctgttgataaactccacaacctccctgcttctctcccccaccagggcgatgacgttgacatccgcctttacattcttggcaatcatgcccatcagcgtactctttccaacgccgcttcctgcgaagattcccattctctggcccttgcccacggtcagaagaccgtctatggcctttacccccatctgtatgattgtgtcgattctgggacgcgtcatggggttggagggttttcctgtgatggaatagtatgacacatcctccaccggccccaaatcatctatgggatttcccatggcatccacggtcctgccgataagacggttggacaccgcaatgtgcaggcgcttcccggtattgcggacagcgctgccgtaaccaatgccctcagtctcgccatagggcatcaaaagcaccttgttctcccggaagcccaccacctcggccatgaccggagaaccgccctccaccacatcaatggtgcacacgtctcccagcctgcaggccggtcccgtggactcaaccgtggttcccactattttgtcaatcttgccaagatatgtgtacaggccggcattctcaatgacccgttctatctgttccagctccatatgcttaccgccttactcctgactggtcagggccgtcagctgccttttcagattatccagctgaacatccagtgacgcgtccacgatgccctcctctgtctctatctggacaaagcccgggggcctgctttccggcttaatgcggagtacaccgcccattttatccttcaggggttccaggcgcttttcaagaacctccaccagccccacggcatcctccggaatgtggaccgttatattctccttatcccgttccgaaagcacggcagacgccaccatgtccgccaattcggacgcatcatactccacctttttcctgagtattttttctgccatcataaaggccaggccggccaccttctcattcatccggctcttgaattcctccagtccctgacccatccggtcaaccgctacctgtatgccggcaacatccctcgaaatatcctccagcgcctggtccattccctggctgtagccttccttttttgcctggtcatgtatccttccggcttcgtcccgtgccgtgtttactatattgtccctctgggcataggcttcctccagtatcctggcagccgactgttccgcctgctctctggcatgctccagaatcttgcgcttttcctccgatataagggcataccgctttccggctgcgtcctggccgccggttccggctgcacccggtccgctggctccggccccatggccctccggatttcctgtcccgtctgcgttttccccggtccggggctgtcccggcgctcctgcgtcagtctgatataccctgaccctggcatggcccgtgacggtctgtccctgcttcaataccctagacaattatctcatcctttccatccttggaaatcacaatctcgccttcctcctccagccgcctgataacagccacaatcctctgctgtgcatcctccacatcgctcatacgtatattatgcagatactccatatcgctctgtatggattcccgcatacggttggacatattggaaaatatggttgcagtaacatcccggttggcaaccttcagcgccacagacaaatccttggaatcaatctcacgcaggaacctctgcacggacagggggtccagatatgcgatatcctcgaatacaaacatgagcttgcgcacatcctcggccagctgcggattcttcatgttcagctcgtcgaaaatatcccgctccgtgctgcggtccacatggttcattacatctgctatgtagttaagaccgcccacttccatggtttcctctgatgaagaggaaccgattttcttttccaggacctcttcggctatcttgatggccatgggaagggcccggtccatattggcaatgcgctccaccacatccaccctggtgtcctgggaaaggttggctatgatttttgacgcctgttccggcgttgcgtaggacaggatgagagccagtgtctgcggatgctcattctgtatggctgccatcagtgtcttataatccacttttctgataaaactgaacgccttggtcttcagggccttgctgacccggtccatcaggttcctggcctgctgctgcccgaatgccttttccaggacctccttggcatagtcccgtccgccctcggttatgaccttctctgtcacgcagcagttataaaagtccttggcaatgtcttccaattcattttcagccagacggggcagacgggtgatttccatggacagctgttccacctcgttttccgtgagataccggaacacctcagatgcccgttcgctccccagtatggatatgacagccgctgctttctctgctggccttctctcttctgcaggcatcttatttcttatcctccttcagccatgaacttatcatggatgcaataatttccggattcatctgtgcaaaggagcgtacctgctccaccgggtcatcggggttcacctgcatacggcccaggtcattgtgcaccgcctcctcctcggcccggtcagctgcatctgcctggggcggagcctctccctcaaagggagcaaacagctcctggtcttccttcatctgcctcctgcgcctgcgtccgaaaagcaggaacaaaagcaggaggaacaaaaggattccggctccggccgcaatggctatggtcctgtagtcaattcccgtatccacaggcgcctgcaccggcagcgccggttttgccggagccgactccttgggcacttcacggaaactggacaccacgatatcctccggcgcaatattggctgccttggaagccgcgtcaatcagctgctgtttcttggcctctgtcaggttatcgtcattgaccgtgatggccacggtcgccttctgcagtttaacattgtccttttcaatctgtttctttatgtagcttacaaggtaatccacatccctgtaataatccccggttccctgggccgcgccgcctgttccggcagtaccgtaggcaggtatgtccgtgttgttctcctccccggcaatgcctcccgcgccggccaggcctcctgccgtgcccctgctttcccggtagtggtccaccactccctgtccgttctcctggggctcgtactccagattctcggttatcatcttgtcgtagtctatgacaaccgtggcagatacccggattttatcgggaggataggccagggtcagtacatttttgattttattctgtaaccgttcctccaccttggcctcaaaatccagacggttcagaccgtaggccgtgtttccgatatcatcggacaccatctcctgcatggactccgcgttgaccacggttacatgttccggcagcaggcgcggtacgctgtccgccaccagattcttgatggccgataccttttccggtgacaagtcataggacggcattaaagtcaaagaaacggagcctgtactgccggaatccccatcatcccagacataagcgctctcatcaggcacattcaatgtgacgatggcgttcttaataccggtcatgtccttcagggtgcgttccagccggtcctgaaggttcataaggagatactgccgcttctcaaactccgtggtagtaaaacccatattatctgaaaaaatatcaaaaggaagcgccgttttcggatatcccagttctgacatctcaatcatgatgtcacccagctgttcctccggaaccgtcacttcaccctcatcatttcttttagccggcacgcctcttccgcccagcactgccagaatctcgttattctcctccctggatatccctggaaacaatgttacatagcttccgacattccctctgtttaataaaatgctggctgccagggctatcactatagccgcagccacccccgctgccacggcttttcttttgccgcttcccaggactcgtcctatggcaccgtttcctccggctcctggttttatcttatcctttatccccatgattcaattgtaacatccttcatcccgtattagacctgcatacccataatctgattataggcattcactgcctttgaagtaagctgagtggcgaactccactgctgccgctgacttttcagcctgtatcaaagcggtatgcaggttatccacctgccctgatgcaagcttcatatccattatccgggtgtccctgatggactggtccgcctccctgactgcttctttaagcacattgttaaagctcttctccgggaccgccttaaccgtgctgtctccctttaagtcagataaagagcccgcaccctccatccttgtaaccggtatgatgaacataatcttcccccctgtatacctcatgttatttacacaattatccaatattttaagtatatccccattcagtcactcagtcaacaaaaataaatgtttttggaactgttttgtaaccattttgaccctgtttacagggaaaacaggttgttggtaattgtttccatgcaataaagctgatataaagtccgcataaaaagcagcggcaggatatgttttccatttcctgccgctgcctaatcctacactgccctatggcagcctgcccatagctgctttagcgttcctaaccatgccagataccggaaccatccagataccgtccctccacataggcattcttaaccatgcgcccgttttccggactcatataataccagctgccgctgtctaagagccatcctgtatgcatgctgccgtcctggtcaaagaagtacatgccgtccccggccgcaagccatcccttatacatgatgccgtcatttcccaggtaataccatttacggctgtcctgtaaccagcctgtctgcatgactccgttgatatccaggaaataataattgccgtccttctgctgccagccggtcagcatatacccgctgaaatcaaagagataccatctgccgtcaatgtttttccaggttccggcgggataggtgccgtccgtattcctgtaccaccatccttcatcgtccttaatccatcccagctgggacggcgtcagtgcatcgcccttgtcaggaccgcccatgttccctccggtcagggtgcagacctcatccgcgtctatgtccagctcgtctgaatatacccagtcgctgctggtgatataggctgtctcctccgtgtccttgggaatggccctgacgcggaactggtatgtccctgccgcagtcatcagaggatagaaatcgtaattagtggcaatgacctttggtatgccctggaccatctgcccattgcggtagagcttcagctcataggcgcccgcgtaagggacctgggcccaggtggcttttcccggcgggtatcccatccattccgctgtgtccggtatctccagggtgccggaagcaggtgtcagcagtaccgtgagaagcagggtttcgtcattgttggtcttttttaccgacttataggaagctccgtcaatctggaacttgcttggtcctgtgaccctgttgaaataataaccgcttctggcatgtatctcaatttgtaccttgggttcatcccccggctcccagtaatccttattattcttggcaacccatttataagcgcccacggtatacaggctgctgtccgtggtagcatgcaccgtagcctcgttgagttcataatccgcctgcacatcagagcggacccttaatgatacgctggtaatgggtgtccttgtctctgtctttactgctgccatggatacagcagggaatgccgctgccagcaacgcccaaatccccatggctgcagccgccttcttccatccatacatccttttatcctccttctgccggttacgggacccatatcccttcctgattcacataatgctggtccacagccatatcccgcaccatccgcccgcctgacgggtccagatagtaccaattcccctgccacagcagccacccggttgccatactgccgtccggattcagatagtaccagtcgttcccctgctgcagccactgtcctgtcagctttcctttctccgggtccaggtaataccagatgcggttgaactgaagccagcccgtaaccatgtccccgttggatgtcaggtagtattccctgtcgttcttccactgccagcccgtaagcatatatccgtttatgtcaaacagataccacttaccgccaatctcctgccagcagcccacgggataacttccgtcctggttcctgtaccaccagccgtttttgtcctgggcccagccgggggcctgggcattgggtccggttccgtccttcacactgacaccggcggttccctttccctgggacacggccctcttatccgctgcctgggcatccttcctggtaatctgctggttgtcagactcggtccatcctcctgctttcagatagtcagactctgactccgactttgccacagcccttaccttgaaatagtaatccccttcttccgtcatatagggaaagaaatcatagctgacggaattggtcctgggcacatggtaaaccatgctctcatcacagaacagctttacctcgtaggaggaggccccctctaccttggcccatcttgcttttcccaaaggtgtttcctcccaatgggcctcttccacctggtccagtgtccccttgacgccttttagctttgcagtaatggtgaggctgcgctttgcatcgcttttcttggatgacacataatccgcgccccgtatatgcgcgctggaggaactgatgcttccgaaatagtactcgtcctcagcagccaattcaatggttatacgcggtgtctcccctgccttccaggatgtctttccattgataaacccgcaggacaccacatgatacttggtgctgtccgccgtggctgacacgcttgcgctgccccccacctccacggaagaggtaaccgctatggtcaccgacttaatagcctcgtccgcataagaaaccatggcagcggaccaccatacccccagcacaaggaacaatcctgccgctgccctgcaggaaacatgtatcagcctgtttctaatccccatcttaaacctccccttatcctttatccccgttactgccatggcctgcgtatggatacaatggtccggtaggccgggtcattgctcaccttgataccttcttttctggaactggcatgtacgatacggcctccgccgatatacatggccacatggccggagtagcacaccaaatcccctggctccatatcctcatacggtacctctctgccaaatccggcctgttcccccgatgttctggggatactgacgccgaaatgccggtatacggactgggtaaaaccggagcagtccgttccgttggtcaggcttgtacctccgtatatatagggatttcccacaaactgcagggcatagtccgccacatttctgccgaactcagtgccgcccgtgctttctgccggcttgccgctgcttcccggttcctgccccggacccaggaccggcggctcctgattggcgcctcccggtccctgccctatgcttccctgctcctgcctgatgcgctcctgctcctgcctgatatgctcctgcctgatacgctcctgcctggcacgttcctcctcctgcctggccctgagaatgcgtatctcctctgtcttccttctcacttcaccggccgcgcgggcggcccgtgtccgggctgcctccagttcaagggcaaatccgctgctctctttttccctctcccggataaagccttccagctccttttgctgggactcattctcctcttccatgacctccagctgggactgtttctcctccagcagctccttttttccggcagcttccttctttagccgttcatacctctctatgatttgccggtcatattcatagagctgtctgaaatattcggtctggctgaccacatcccctatactctttgcctttaaaaggatgtccagataagtgatatccccttcctcatacaggaactgaatcctctttttgagaatcccgtactgtgtccggcgctgttcctcggcctggcggtaatccaggccggcctggtgaatctgcgccttcagttcttccatatccgattccagtatatcctttagggccagcagccttaccagttcatcctccaggtcctgttccttctgcctggactctcccagcttctgttccagctgctctgcctcagactctgcccgggacttttcttcctctgcccggcgcttttccttctctgcctttgtgacaggcgatgcgcggcctggcacaggcgcctggactgccagcacaagggctgccgcaatcagtaccgccctccgccggcgtccccggttaccactcattcccataccgttcttatgtataccttttaacccttcccaaattacacatcatttttcaataatgtcagtatagcacaaatgtaaccaggaaaaaagcctgaaaacagaaacatcccggtacaggcctgcagtcatgctgccccgcaccgggatatttccgtaaaacccctgtataactgttaaccttccatctgccgtcccagaaacccggcagccgtggatgccagttttacctcggcgtccccgaacttggccctgggctcgcggctcatgagagccaccgcgccgatggcatcgccttcacagatgattggcgcaaccacctgggcgctgattccctccagctcctcgtccaccagctggatgaatgccttgtcttccctggcggcaatgacagtgctcctctcattgatggcctgttccagctgacggctgatatttctctgaagcaggtccttcttggctcctcctgccacggctatgacctggtccctgtccgtaatgcatacgaaaaggccggtggactgtgccatggcctctgcatactgcacggcaaatgaggtgagttccatcataggcgagtattttttaaggatgatttctccttccctgtctgtgaatatctctaacggcgtaccttccctgagccttaaggtcctccgaatctcctttggaatgaccacacggcccagatcatcaattcttctgactattcctgtagctttcataaacaaaattcctccattttactttctgtcatttatcttctttgttgcccgtaaatgtagtatctgtaaaacagaggaatttatacttaaagtaaccttcaaagtaattatgaagattcaaagggctgtaactgcctttatatttttttgtggtcgccccggtctgtcacaacctcatacccgatggatgccatcctgcgctttaattctttaatattggctgcggcttccactcccgtgctgattttattatcataaagcatatactttttccgcacttccaggggagacaggttgggcatcaccacattggcccctgccatcaccccctgttccctgccgtccggttcaatggttcccagggctgtggtggctggcagcagcacatccggaagcataagccgtacaatggccagcagcaaaagagtctggcggaggcttccggcgggcctgtccttaaaaggagtatcatgatgggggatgaacggtccgattcccaccatctccggctgaaggccgtgcatgaattccaggtcctccgcaatatgggccgttgtctgatagggcgagcccgccatgattccgcagccggtctgatatccaatggccttcaggttctgcaggcactccttcctgtattcagaagacatctgagggggatggagactggcataatggcatggattagctgtctcatggcgcagcagataacggtccgcccccgcatcaaaccaccgcttgtaagtactgtaccccttctcccccacagacagagtaaccgcacagtccgggtactgctgtttgatgcgctccaccagataggctatcttctcatccgtaaaccatgggtcctcgcctccctggaacacaaaggtccgaaaccccagtccatagccaatccggcagcactccataatctgttccggcgacagcctgtaacgggacgccttctggttgctccgccggataccgcaatagtagcagtcatttttacagtaattagtaaattccatcagaccgcgtacataaatccggttcccgtaattagccagggcagcttccctggctttttcatacagataggattcctcctcccctatgttatccagcaggaaaataaattcctcccgggacagcatatgggtttttgccaacttatccaccagtgtggtcacctgctccatcatgcacctctctccattttatcttttaatcccacaggcaggacacaggtatatgtcctgttcctgagtttcagcggatacagcctgacctccaccccaaacgcctcattaaggtgttcctcgctgagtatctcatctgtgggtccaaacagggtagtgccatgggaagtgagcagcagcgctttttgggatatggaaagggcgtgttccggataatgggtgttgaccacggcggatatatgtttttccctgcacagacgttcaatggtttccagtacaatgagctggttcctgaaatccaggttggattccggttcatccagcacaaggatggacggattcgtcgccagtgccctggcaataagaaccatctgcagttccccgccgcttatatggctgcagagcttacccttaagatatccgattccaatctcttccatacagtctcctgctatttcccagtccctctttttaggctgcccgaaggtgcccagatgcgcatttctccccaaaagcaccatttcctctgtgctgtaggcaaaggcagacgcctttgcctggggtacgtatcccaccttccgccacagctggttatacggtatgtcccttatgttgacgccgtccacaaaggttcctcctgttttccattccagaaggcccagcatacatttaagcagggtggtcttgcctgcgccgttggcccccaggatggacagcacctggggctcatccagggaaacattcacatgttccagtatacaatcattggaggaataaccaaatcccccgtccttcacctcaaatatcataaacggatacctcctgtctttctgagcagcaatatgaaacagggcgctcctataagggatgtcaatatggatacaggtatttccgtggccattaccgacctggccgcagtatctatgataagcatgaacagagcccccgacgccatgctggcgggtaccacggagcggttgtcatttccgaatatcatacgcaccatatggggtatgagaagccctacccacccaatctgcccgcacatggaaaccacggccgcagtcaccatggctgcccccagaattacaaggctccggattctcttcaccggaatgcccagggactttgcctcgtcctcaggaagggacatggtattgagtttccatctcaaaaggaacaaaagcagacttcccgcaatgataaagggcgcccccataagaagggtggtcctggtggtggatgccatgctgcccatgagccagtaggtgatggacggaagcacgtcctgtgggtccgccgcatattttaccagggataccagggcggaaaacagggagctgaccaccatgcctgccagtatgaccatcagcggaggtatggtccccctgacctgggccacgctccaggccataagcacggccgccaccccggccgccatggcaagagtctgtatgccaaaggccggaaggcctaacaggatacccaggacagcgccaaaggaggccccgttggcagctcccaaggtatccggggtggccagggggttggcaaacagcccctggaatgctgccccggcagcagccagtcctgctccggacaatagggccagcaccacccttggaaaacggatattggatatgaccgtccttacctggtccgacacctggacgccgggaaaggagcccggtatcagcacggctgccagctcctttggagcaatggtaaaacgtccgattgccatagctgcagctgcagctgcaaaaatcactgccagggaacccagggtccagtaccggttccacgtttgtttacttccactcatggttatgttccatcctcatatagttctggtaatatgcccgggcacctatttcttatacccggccgctgcctcccggccaggatggtacatcctctgtacctgctggctgctcagctccacaccgtacatttcctcataataattctttacctcccgggtgatatccacatccgggaacaggtccggatatacctgttttgccatccacaaaagagtcatgggcgtatccgtgctgggcgtatagctccggtaggttcccaggggaagcttgtatacctgtttgtcctgcactgcttttaccggactccagtcatcctgtcccactgcattttcatagaggtcctcaggctggaccggggtaaaattggtgatgaatataatgtccggattccactcatatacctgttccatgttgatgactgcattggaattctccgctgccacgccttcagccacattgcgtccgcccactgcgtcgcaccagaactgaccgaaaaatttcctgcctgaggtcaccatggtggtatcgctgtaattaaacaggaacaggatattcttcctctcctcatcctttaatcctgacaccttgctctggatatcctcatataccttctggctgtattgggacacccgctccgatgtatcccccttctccggaaaaatccggctcagcaggccaatccactggtcatacgtctctatgctgtcgtaattccatttatttacagatactgcaactgccgcaaatccggcagagcgcagggcctcccctatttccttgctgcctgcattgtaaaataccacatccggttccagcttcatgagttcttccatgttgatgtcgctgccgttcatgaaatccgtactggcatccaggatgtcgggaaacagctctcccaaaagccctgttttggcagcgctcatgctggcgggggccattcccactatcttttccccggaccccaggaacacggtgatgatggagggaagcggcagtatatccgtaaccaccacccggttcacttccccgggtatctccacctgattgcctgcatggtctgttatgaccactgtgccggcggaccgggaggtctgcggttccctccggcccttgtctgcactctggccctcatcagggttctgaccgctgtcattctgtcccttgtcattctgtcccttgtcctcctgacgctgactttctgcagcctgaccgcctggggcagacgcccccggtgccccggactggcagccagaaagtcctgctgccccaagacacacacctaaaatgattgctgttagctttttcataatacctcttcctccatttatttttccccggaacaattcaaagagcacacaaagggcttcataatgctgtgatacattctgcctgaacatgcctcatggggaaaatccacaaacaccctatttctgtcagcagggcatacctgacggtataaggggtcagccaccacaaccgtactctccgctataccggaaataacttcatcctcatcccagtcaatgatatctccttccatggccaggtccttctctcctccggccggacaaagcaccgtcacctggtcagctccaaattcctccctcaggctgcaccgcagggaaccggcaatgacctgttccccgattataagtaccctctcaccggacaaatcatccggcagcccggaaagccccaggtcaggccgggcagccccggcggaaccggcctccggctgaagcgaatttgaatccggctgcagcgcattttcagcatgttcaaacaaacagcggttctcacctgcttccgccgcctgcctgatataccctgccagccgttcagatgtcaatcttcccacaggtgttcccaccacgtaaggtattccgtacagctcctttaacgctccggccgcaggcagccccgctgctgataccaccagatttacgtctgccaggccggccagacgcagttcatccagactgctttccatggcccagcagcccccgttctccattccatggtcactgagaaaatcctttagtctggcagtatttcccgtaagtgaaaaatccagcggggtaacgcccaggacattcaccctcagggcatgctcccgttccgtccccttgcggctggttccgtccgggctgcctgtatttcccgccagcttttgcagctccgctccgggcggacagaaccgtttcacaatctgcctcagcgcctcccctgccccgcggacataggagtgcattccattggtggcaatgccgaaggttgggataccggtctgtttttcaatcatcctggcaattcccttaaagtcagtccccatcatcatgggaatcggggttcctcccatacatatgaacgccggatgaagattcgctgcagcgtccacaatatcctgcaccagctttccgtcatcccccatgactgcttccagctccgacagagccgaaatatacaccatgctgtccatggagtaccatctgggctcatcgtgggtggtataggtggaattacagcctgaagcatcatgcatcaccgtcattccgcccagctcatacagggccgagcagacccctgatatatctgccgcatataccggcagaatccggtttgtccgtttcaacagcagcacccccatccttttacctgtatcagtttttccgtatccttttcttccctggcagcctcctccatcatggcggacagctccaggatgccgccgtaaccgtacagtcctccgtcctccaccatgtttacaaaataaggcgttcctgtgaaataggcagccttctgtcccactgccagcacttttcctcccttttcctgatgccatgtcctgggaagcaccgccatcttgtggtacaccgtgggacagagcagcatccggggacaatgttctttcagccaggcaagcgtatcctcctcctccggcgatatggtatccgcataaatccgttccacccggaaaccgcatttcacaaacagcctggccattcccagcggtctggaagaaaccgtatagtcaatggccaccgaccatccctccagtttccttgcaagcgtttcaagggccgtctccgccttctgccacagctggtccagttccccgtctttccacaccgcattaaagtccagttccagcaaatccgacaggcatttccagtgctcccttatctgttcccagtcatagctcaccggcagatagacccactcctgtcccaggcgctcactgagttccttcgcagcaggacgccccagcggatttgtcaccagattgagccgcgatgatgccatggcctcatattccccgaagtcccggcaggtgcatatatcttttaggaaaaatccgtttttttccaatatagtgtgcagctctgagctccttcccatggccaggttattgccaatgatatttatctgctgcctgtgcatatctgccggctttaacagggaatacagctgttttctcatgaacgggtccggcggcatctttgtctttctcataatggggttcatccagcactgcacgaagcccacctgcggaaaccgtgtgttcagctcccggaataccattttcatatctgttccaagaaaatgatggatacagctggtaaacagcagcagggcccttggcagcaccggcagaccctccaggatatgggtcacgccctcaatgatgatatcctcacagttcccctccagcaccgactcctcatccacggatatagtggaaaaacggcggctgtcattcagctctgcagcagacaatacaacgccccgcaggcagctctgggcacacacgaacacctggtggctctccggcagcagcatcccgatatgcacaatggtccatcctcccctggccggggcgctgtactccaatccgtaggtaaacggggccaggctgtccacctgggacagcgcaagggccgcgtcctggcctgctgtactctgtccggttctattctgcccggttatgctccgcccggctatcccctccccggcacattcatgcagtttcttaagcataggctctcttcacctcttcctccccgcaggccgcgagaacagcatccgccattttcctgtactgacccgcaatgccgctgtccggataagcttccatgaccgtctttccaagctcctccgcctctcccaccagggagctgtaatccagggaagctatgatttccgttcccatatcctctgccagctcctccaccttttcctgttcccgcttcacgcctctgcggttaaggaggatgcctcccaggctggcataccctctggcctcaaaggatttcactgctgtggcaatattggcggccgcatagatggccatgttttccccggatgtaacaataaataccttgtccgcatacccctcccggatgggcatggcaaacccgccgcagacaacatcgcccagcacatcataaatgaccacgtccggcttataaacctcaaatgcatttctctcctccaatgcctcaaaggcagtgatgattccccgcccggcgcaccccatgccaggggtaggtcctcctgcctcagcgcagagcacacccttgcttccctctgtcaccagctcgtccagacccgccttatctccctttgcccggattatatccaggatggaggccacggcccgtccctgatgaagctgtatggtggaatccgcctttgggtcgcagcctatctgcattactttgtacccccgctccgccagggccactgacaaattagatgagatggtggactttccgattccgccttttccgtaaaccgctatctttaacatatctttccttcccctctgttcttgaaataaaaaacctctctctgaaattcagagagaggatataatcaacaagtcacggcttccgctgcaggcacataagccacacccacaaacagcgcacaccggaaaataacacaaaccggcgcctgcacagccaggacagttccgctctctctttatctcagggttgcttcgcatcagagaaaggttctatttagttactaccatcatattccagctcccgtgaaaaagcaagggttaaaaaaatatcttgtcctgcgcattttattaggctttacgaaaggccgggacccatgatatcataaccacagacaaccgcggcccgcatatgggtgtgcatctgatttttgcagagccctgccgggtaaaaaacaataagggaggttatactttatggaagaccgtctggctgttatcagctgtatcataagcaaccctgactctgtggcaacggtaaacgaaaaattccaccttcagtccagtctgattattgcccgtctgggcgttccctgccgggattacggggtctccgtcatcagcgtggttcttcacggaacccagaaccaaatcagttcctttgccggggacctgggaaaggtagacggtgtaaaggtgaaatccattcaggtgccggtcaacaaataaaagaaagggaaggaaccccatggaacatttggaatggctgctgtccctggtagcaaacatcgcaatcattatatttgaatttatcggcgtgggcatcatcatatactcaggcctcacaagtttccttaaattcctccgcaagtccccggacaccaagatttatctggcaaagggcctggccatgggactggaattcaaaatgggaagcgaaatcctgcgcacggtcgtggtccgggagtggaaggaaataggaatcgtggccggcatcattgccctgagagccgcccttaccttcctgattcactgggaaatcaaggaagaggaacgggcctgatacacacagtaagaccgcgctgcagggaaaatatctccccgcttagcgcggtctttcttgtgtcatggtatgaactgggggagtaaaaccggttaatgctctgccctctgccgcttcccctgccacaagggcctccatagtcctctatagacgaatcccgcacatacccttcagtatttcttccgccctgcccatcatctcaaggctgtcctggttcttattcctcctgtcaatatagtggaaggagggcacatctgcgggcaccagcttcaggtcccctttgtaagacctgaccaggtccggaatcttttccacctggagctttgccttctgatacatggtaagccttacctcctggcggttaatcaccacttctgtcacatatgcccggtgggccagggccctgatggccgctatcttaagcaggttctccacactgcggggtatatccccgaaccggtccataagctcatcctgcatatccatatattcttcctctgtctcaatggcagagatacgtttgtagatatccagcttctggtattcattcttgatataacgtccgggaatgtatgcatcgatatcgcattccacaacggtttcgtaggaatcctcctccaatgtctctcccttaagagccagcacggcctggttcagcattttgcagtacaaatcataccccacagcctccatgtgtccgtgctgctccgcgcccagtacattgcccgcgccccggatttccaggtcccgcatggcaatcttgattccggaacccagttccgtaaattcccggatggcctggagacgcttctccgcctcctccctcagaagtttatccctcttgtacatgagaaaggcataggaagtcctgttggagcgccccacacggcctctcagctgatacagctgggacagtcccatgcggtccgcatcgtggataatcatggtgttggcattgggtatatccagaccggtttcaatgatggtggtggacaccagcacatcaatctctccattgataaaatcagccataatccgttccagctcatgctcccgcatctgtccatgggcaaatgtaaccactgcatccggcacaagggcctgcacacggccagccacctcatcaatatccgtcacacgattgtatacataatacacctgaccgtttcttgccagctcacggttgattgcctcccgcaccatctcctcattgtactccatcacataggtctggatgggcgtccggtccaccggcggctcctccagcacgctcatgtcgcgtatgcctgccaggctcatatggagggtcctgggaattggcgtggctgtcagggtaagcacatccacattttccttcagatgcttgattttctccttatgggcaacgccaaaccgctgctcctcgtcaataatcagcagccccaggtccttaaactgcatatccttggacaggacccggtgggtcccgatgacaatgtccaccattcccttgcgaaggtcttccagtgttcttttctgtctggcaggcgtacagaacctggacagcatatccacccgcaccgggaaatccttcatcctctgtacgaatgtattgtaatgctgctgggccagaatcgtggtaggcaccaggtacaccacctgcttactgtcctgtaccgccttaaatgccgccctcagagccacctctgtcttgccgtaccccacatcaccgcatatgagccggtccatgattctcctgctctccatgtccttctttaccgcgtcaatggcatccatctggtcatcggtttcatcatagggaaacagctcctcaaactctctctgccacaccgtatctgtcccgtactggaatccggccttctcctggcgcgccgcataaagcttcaccaaatccttggcaatctcctggacagctccccggaccctggtcttggttttattccactcagttcctcccagcttgttgagcttgggtttcttggcctctgcccctgcgtatttctggatactctccagacgggtggccggcagatagagattgcctccgtcgccgtactcaatcttgatatagtccttaatgaccttatcccgctcgaccttctctatgcccttatagatgcccagtccgtgttcctcgtggaccacataatcccccaccgacagttctgagaagctctggatggccttgccctggtaatttgtttttttccggcgcttccgctttttctccacgccgaacatatcgccttctgtgataaatacaaacttcaaaagaggatattcgaatccgcggtggagattgccgtaggtaaccagtatctctcccggctgaaccttgtggacggcagcgcccgccgaatccgtattcccggattccggtatgacattttcctcacctggggaatctcccctttcggcagcccgcacatccgggcaataagccctcaggccgtattccctcaggtcactggcaagcctgctggccctggttctggatgcggacagcaggataaccctgtatccttccttcttccacctggtcaaatccttgataagcatctcaaagctgttctggtatgagttcacattcttgacatcaatactgaatttccggtttaccttcatacccggaagcttctggtccaatcccgtaagcatgactgcaacgggcttctgtattctggccaggacctcagcagccggatacagaagctcggtctggcccggcagcagatagcccttttccagcctgtgcaccatgctttccctgaattccagctccacgatttcgcccttttcctttaacctggcaggctcatccaggtaaatcacgctttccccctgggggaaatattccaggaaggaaaccgtatccgggcagaaataccggatataggcatccagcccgccaatcctccatccctcatccaggccgtttctcagttcttcgataatggtgtggattctgtgggcttcctccggcttatgctgctcccttaatgccttctcatatgccttttcttccgtttccagccttctgattccgtccgccagctggtccccagacaatactacttccgcagccggatatatggtaatgttctctaactgctccaccgaacgctggctctccaggtcaaaggtccggatggagtccacctcatcatcccacagctcaatacgcaccggtacttcctcggtcagcggaaaaatgtccacgattccgcctctgatggagaactggcccatcccgtctacctgggccatcctctcatagcccatggcaaccagacgttccttccagacatccaaatcaattacctgtccgctctccaccgatattgactgctccctcagatatttgagaggcagcagatggtccataagaccatccatggtggtaaccactaccccctctttgtcctccataaggtggcgcagcacagcaatcctctgcctggtcatcagatttccatgaatgtcagcgctgtaaaacagcaggtccttggcgggatacagccatacctggctggtaaagctgcggaaatcatcatagatttccttggccctggtatcatcataggtgaccaccagtttccaggcaaacgcactggcctcccccagttcatacatcagatgtactttctgggaatccagggtcccggttacctgtaacggtccctttccggatttcaacgcctgaaccagattatcatattcctgtaattccaataatggattttccatttatccctgcaccccttatcaacccttgtggccgttaaactgattcattgccgcgtcagcgccctgcgtaatcatcatctccactgccccggccgcttccttaaacgcattttccatgacagccctgtcctccttggagaaccggcttaaaacatagtcagccaggtccattttcttaggtttatcgcccactcccaccttaatgcgtgggaactcctgggttcccaggtgggcaatgatattcttaatcccattatggcctcctgcgctgccctttttccggattcgcagctgtcccacatccaggctgatatcatcatatacaataataatatgttccgggtccactttatagaaatcagctgccgcccttacgctctcaccgctcagattcataaaggtctggggctttaagagcagcaccttctgtccgccgatgattcctcttccgtaacaacccttaaattttttctcctccacagtggtgcccaggcggtccgccagcacgtctatgacctcaaatcccacattatgtcttgtcttttcatactccctggtgggattgcccaaacctgcaatgatatacatcaccttgtcgtcctccttacggccttccgctttctttccaaatcccagccgctcttttattctctcccatattccgctcatattcccgccactttaccttccagttttatgatttgtcttactcattccctttgcatttcccaatatcttcctattattcaaaacacgccttaaagcgttagatacacaccacatggggtatctaacgcttttttccgttccctcattctatcagattacgcttaaaatgtaaagcagatggaggcctctttcctccatctgccgttcttttaattttccagtctgcacccgccagccgcgatacctgtctgcagctcatgctcccgccgtcacaggctgcttcccactgccattgtttccaaagcccgttcctctgtaaaatatccgcattccaccaggcggtccaaaacctgctgctgccgtctggccgccagctcctggctcacagtgggcgcatagcaggatggtgcgttgggaatccctgccagcaatgtgctctcataatccgtcatgtcctcaggctctttgccgaaatagcccatgctggcatcctttacgcaataatacccgttcccgtaataaatcgtattgacatacagctccagaatctcattcttgctgtaattccgttctaaatcaaatgccaccaggacctccgccaccttgcggaccagttccttttcctggctgaaatacatgttcttagccagctgctgagtcaccgtgcttccgccttccacaaaggctcctgcctttatatcattaaatacagcccttccaatggcaatgacgtcgattcccggatggttatagaatctgtggtcctccacggacagcactgcatccacataaatctcaggaagctggtcaaaggtggtatagttctccttagcacgtatggacgccaccttatcctcaaggctgacgctgtccatggcctcccggtacattccgtagcccttggcagccactgtcacgcagaaacacagcgccaccgtaaacatgaccgctgccacccattttatacctgtacgcaccttcatcctttcacccgctttctcttctgaatcctgtattgtggaaccatcttatctcatatatgtatcatatcacaagagaatgcaataatctttgaatttgccttaacataccgtgactattctctgactatttatgaaattttttctaaaggtctgattggtttttcttaaggatttgagcccctcatacacaggtattttaaggcgttccgcccttgcataacgcctcatactatgctaaactataaccgttgtgatgcctgtataagttcatgattggatgaacgtttctaccagctaccggaatagttgactacatgcttctattttgcatactggttttttttgtgccctggaatggattttaaagggccagggaacgccggatgtaccgtatcctaaggcattccgcgaaaccaggcaaatcaggcagtgaaagaaaggagtttccctatgaatccaaccacaaattacgacgtaatcattattggcgcaggtccttccggcatcttctgcgcgtatgagttaatccagaagaaacctgacatgaaaatcctcatggtggagaaaggacgtcccattgaaaagagggtttgtccaaaacgtaccaccaaggtatgcgtgggctgcaagccctgctccattaccactggttttgccggcgccggtgcattttcagacggcaagctgtccctttccccagacgtaggcggcaaccttccggaaatcctgggttatgataaaaccgttgaactcttaaaggaatctgacaacatctacttaaaattcggcgctgataccaatgtatacggcgtggacaaacagaacgaaatagaagaaatccgccgcaaagccattggggctaacttaaagctgattgaatgccccatccgccacctgggaacagaggaaggctataaaatttatacccgcctccaggaacatcttctggcccagggcattaccatggagtttaacaccatggtcagggacatcatcattgaaggcaataccgtaaagggtatcattacagacaaggatgaaacctactatgcgcctgaggtggtttcggccattggacgggagggttctgactggttctctcatatctgcggcaatcacggaatccagacccaggtaggcaccgtggacataggcgtccgtgtggaggtccgggatgaggtcatgaagttcttaaacgagaacctgtacgaggccaagcttgtatactatacccctacctttgacgacaaggtccgcaccttctgcaccaatccatccggagaagtggccacagaatactatgaaaacggccttgcagtggtaaacggccatgcatacaaatccaaggagtataagactaataataccaactttgcccttctggtgagcaagaactttaccaagcccttcaacgagcccattgagtacggcaagcatattgcccagctgtccaatatgctctgcggcgggaggattatggtccagaccttcggagacttccagagaggccgccggaccacagaggaacgcctctgccgcaacaacctgattcccacactgaaggatgcagtacccggcgacctgtccctggtattccctcaccgcatcatgacggatatcaaggaaatgctgctggccctggacaaggtgactcccggaattgccagcgacgaaaccttgctctacggcgtggaggtcaagttctactccaataaagtagtggtaaacgctgactttgaaaccagcatcagaggactgcgggcgattggagacggcgcatccgttaccagagggctgcagcaggcttccgccaacggcatcagcgtggccaggagtatcctgaagcagatggaagcataacaggccctgtccggcatacacggtcatactcgcccaaaaccacataataccaaaacgtttggaaccccctaattatcaagaggactccaaacgttttttgctgtataatcaaccttttatatgcgctgatatagactccgcatcagagtcaggatagcgcccaatcaaatcatataacttctgcaccacctcttccggctccattaagtcctcagcaatcctggcagcggactgccccctctcccgtttccgcatgacctggtttatcaattttgccatcttcccccgctccaatcccttttcaattcctttgttttcccgttcctccagctcatctgcaaaaagttcccgcagagcatcacacatcttatccacctcctgacatgtttcccagtttgcccgcatgattaagtccatggcagtctcgtacaggggattttgttccttccccttatattcctttaccagtacttcaatatcttcttccggcttcagcccgcttctcaagcggctcagccagatattgcacaggccaacacaaaaaacaagagctgtcccggttcacattggttatccggaaacagctcccactcattgttctgtatgtatcttatgccatcccatcctctgccgcctcattctccagcaaggttgtctcatacttattcagaataatggtctgaatcatatcccttgtgttggagttaatcggatgagcaatgtcgcggtactctccgtccgccgccttgcggcttggcatggctatgaataaacccttctccccctctattaccttgatgtcatgaatgacgaattcattgtccagtgtgatggaaacaattgctttcatcttgccttccttttcaacccgtctcactctcacgtctgtaacctgcatgttttctaccccttccgtcttatcccgccggtcccccgctctgcgctccccgtgcgtaccgcggggctatgtgcgtattataatgtatacctttcgtttttctccacaacgattttgatgttttccggtgtgccgatgtgcgtggtgttggcacggatggtatccctgctctctacaatgcagttctcaatcactgtgttgtcgccaatatagacatcatttaaaatgatggaattcttgattacacaattgttgcctacgtatgccttcttaaagagaatggaattttcaactgtaccattcaggatacatccgctggaaatcaggctgtttctaaccaacgcgccagggttatacttggctggaggaaggtcatcaatcttagtatatacattaggatactgcttgaagaagtaatccctcacctcagatttaaggaaatccatattggtcttataataggagtccacagaagcaatgttgctccagtagccgtccagcttataagcatagattctcttaaggttcttatagcgtaccagaatatcattgaccaggtcatacctgtcctctgctgcgcagcgctccagcagttcaatgagctgccttctgcggatgacatagataccgcaggaaatggtagttgcgtcagatgccatgggcttctcctcaaagtccgtgatacggccgtcatcattcagcttaacgcagccgaaccgtgttacatccgtgccctcttccatgtccttgcagacaacggtgatgtctgcctttttctcaatgtgatattccagaaccttattataatccagcttgtatacgccgtcgcctgccgcaatgacaacgtacggttcatggctgttctttaagaatgtaaggttctggtacaatgcgtctgccgtgcccctgtaccaatcaccgttttccggcgtgatggatggggtgaatacaaacagaccgccctgtttacgtccgaaatcccaccacttggaggaacttaaatgcaggttcagggacctggaattatactgtgtaaaaactgccacgttctggatgtgggaatttgtcatgttgctgagtgcaaagtcaatgctgcggtagcttcctgcaaccggcatggcagccactgccctcttattagaaagttcccgcatcctcttgctgttaccacctgctaatacgataccgattgctctcattttacgccacctgcctttataatgtaatttccgccagccagtaatccgtcaggataatcgcccacggttgtctcgcctgctatggcagtgttcttgcctaccttaaccccgtctggaattacagaattctcaccaatggtcaccaggtcgaactgatataccttggggtcatatgtactgggtgcgtattcgcctgttcccagctccacgcctgagccaatccttacgttctcagcaatgatggccttattaacaacagcaccggctccaatggcggtcccctgcattacaatggaatcctttaccacggcacccttggcaatggtaacgcctgctccgataacagagttcattacctcgccgtaaatctcagttccctcaccgataatgctccgctcaatatttgcctcattggaaataaactggggcggaatcacatcattcttggtgtaaatcttccagtattcctcatacaggttgaactcagggatgatatcaataagctccatgttagcttcccagtaagagcccagcgtacctacatccttccagtaaccattatattcataggcgaatatcctgtcgcctcttgcatggcagtatggaatgatgtgcttgccgaaatcgcatcccggctcttccttcatcttaatcagagcttcctttaataccggccagctgaatatgtagatacccatggaagccagattgcttctgggaactggaggcttctcctcaaattccgtgatacggttagactcgtccgtaatcaggatgccaaaacggctggcctcctcaatgggaaccggcatggcagcaatggtgatatctgcattattggctttgtgataatccagcattacctcgtaatccatcttgtaaatatggtcgccggataaaatcagaacatattccggattatatgattccatatactccaggttctgatagattgcattggcagttcctgtgtaccaatcgctgcctttgctgcgctcatatgggggtaaaacggtcacaccaccaacgttccggtctaaatcccatggtacaccaattccgatatgagaatttaaacgtaatggctgatactgtgtcaataccccgactgtgtcaactccggaattgatacagttgctcagcggaaaatcaatgattcggtacttccccccaaaagatacggccggcttggctactttttgtgttagtacgccaaggcggcttccctgtccgcctgctaatagcatagctatcatttcttttttaatcacgttatcacctcttgctgttaaaatttttgtaattttaattataccacaaacttcgtaaatagtacataaatttttaaatttatttcatcgtttttgtgcatttttccgacattttttccgtttttaaccatttgatgttgatttatctatatcttgtacccctttccaaaatttaccactaaataagtccccctcgcaggctgtatattcacggatgtttttgtcaaaaacagctataaacataatatcagataatttgttgccggtgcattccaatttctggaacgcctccagccgcagttatctgacataatctgcatccggcatgacccgcttcagttaagtaacgccccttatgcggatttttccccgttcatatactactataatgcaatcatattgaaaatacaggctccgtacccggactcaggggaaagttaagccttgaaacatgacgtgaaatatcatataatcacgtatatgtagttaccgtccatttccaggggaattggggatactgaatatatagataagagaaaaggagaacatcagtcatggatctgattaccgtaagagaactttacaaacatccggaggaacatctgggcaaggagataaatgtgggaggctgggtacgcagcctgcgcgattccaaagcttttggcttcattgttgtcagcgacggaagtttttttgagacattgcagattgtatatcacgattcccttcccaactttgcggaagtttctaaattaagcgtaggcaccgccattcttgtaaagggaaccctggtaagtactccccaggccaagcagccttttgagattcaggccacagaggtaacggtggagggaacctcctcgccggattatccccttcagaaaaagcgccactctcttgaatacctgcgcaccatctcccatctgcgcgccagaaccaataccttccaggctgtattccgtgtgcgttccttaattgcatacgccatccaccagtatttccaggaaagggattttgtctatgtgcacacgccgctgattaccggcagtgactgcgagggcgccggtgaaatgttccaggtaaccaccatggatttaaacaatattccaaagacaggggaaggcagagtggatttcagccaggacttcttcggcaaggccaccaacctgaccgtaagcggacagctgaatgctgagacctatgccatggctttccgcaacgtatataccttcggccccaccttccgcgctgagaattccaacacaacccgccatgcagccgagttctggatgattgaaccggaaatggcctttgcggatttagacgacgacatgtgcctggcggaaggcatgctcaaatatatcatccgttttgtcctggagcatgcgccggaggagatgaatttcttcaaccagtttgtggacaagggtcttctggatcgtcttcacaatgtattaaattccgagttcggccgcattacctacacggaagccgtaaaaatactggaagaacacaacgatgaatttgactataaggtatcctggggctgcgatttgcagacagagcatgagcgctatctgacggagcaggtatttaaaaagcctgtatttgtaactgattatccgaaggaaatcaaggccttctatatgaagatgaatcctgacaacaagaccgtggccgccgtagactgcctggttcccggtatcggcgaaatcatcggcggaagccagagggaggacgattacgacagactggtagccaggatggacgagctgggccttaagaaggaagactatgacttctatctggacttaagaaaatacggctccacacgccacgcaggatttggacttggttttgagcgctgcgtcatgtacctgaccggaatgtccaacatccgcgacgtaatcccattcccaagaacggttaacaactgcgaattataaagaatacctgcccgccccgctgaagcgggcaggtattcgctacccggacgcagcaacgcggagttcggggaacccctatttgcccgccccgccaaagcgggcaggtattcgctacccggacgcagcagcgcttatggaaccattacttgacaggaggcagacatgaaattcatccacaccggggatatccactggggtatgtgtcccgatgccaacaaaccctggggcaaggaacgtgcccaggcaatcaaagataccttccggataatcatagaaaaaacaaaagagatggatgtggactgcttattcatcagcggagacctgtttcacaggcagccgctgatgaaagaccttaaggaggtcaattatctcttctccaccattcccaccgtaaaggtcatcctgatagcaggcaatcatgaccgcatcagggagaactctgccctgctaagctttacctggagtcctaatgtaacctttatcatggatgaggacctgacctctgtatactttgaggacattaacaccgaggttcacggattcagctatcacacagctgaaattaaggctcccctgctggaagatatacaggtccccctgaacagccggattcagattctcatggcccatggcggcgacgccgcccacctgccgattaactttaacagtctggagctgtccccattttcctacattgccctgggacatatccacaagccccacgtcctggctgacggaaagattgcttactgcggctcccccgaacccctggacctgacagagacaggcgcccatggcttctatgcaggtgagattcatcctgtcaccagaaagctggtaagcctccggttcatcccggcagccagcctccagtacatacctctggccgtgaatgtgtccaaagataccaccaacggcgaactgtgcgaccggatatcaaatgaaattgaaaaccggggttcccagcacatttaccggttccgaatcaggggcatgagggaccctgatattgaatttgacctggagcagttatcggacaaatacaggattgctgaaattattgatgactctgaaccccagtatgatttttcagccctgtttgccgaacattccagcgacatgattgggttctatatccaggccctccaaaaagaagatatgagtccggtggagaagaaagccctgtattacggggtaaatgcccttctgcataccaccgatgaaaggagctgaacccatgaagatattaagtctgcacatcgagggcttcggtaaattccatgacctggatatctcctttaaggatgggctgaatgtggtgtacggcaagaatgaggccggcaaatccacccttcacacctttatcaggggaatgctctttggtattgagaaacagaggggcagggcggccaggaatgacgtgtacagcaagtacgaaccctggaagggaagcggcacctatgagggctggatgcggctggaaagcgaaggacagatataccgtatccagagaagattccagaagcagaacaaggagctgaccattgtcaatgaaaccctgggaagggaggcagaacccaccagagcccttctggaccagctgcgctgcggcctgtcggaaacagcctacgacaacaccatcagcatcggtcagttaaaatgcgccacggacgggggcatggtggctgagctccgcaattacatcgccaatctcaatacctccggcagcattgccctcaacataaccaaggcaactgcctacttaaagagtcagaggcgggagctggaaaatcagatggtgcctgaggcagcccgcagctatactgctcttttgggggatatccgcaagacagagcaggaaatatccgcgcctcagtatgccaatcagctgattgagtaccgtaataagaagagtgaaatcaggaaacaactggacagctgtcagaaggaaaaggaggggctgcttgaaaagtccgccaaggggcggcagattctattaaacagccagtttactgaccaggaatccgtgcagagctacatggaggacaccagaaagctttacggcgactatcagaacaccctggctgcctgcagtaagaaatccaggactgtctgcgccgtattcatgttccttattaccctggcctttgcaggagccgcaggtctgtgcctggctgcgcctgacctggtccgctcccttgtactccttccggtaccgcttactgccgccgcaggcatatccggagccattgccctggctggctgcatcaccggaatccttaagctggggaaaaaccgccggttccgaaaggaactggacaccagcacccgccttctccaggagatatttgcccgtcacctgggggattccagtatatcccaggaggccatgaatgcattggagggccggatggctgagttcctccgtctcagcaaggcagtggaacagtctgaacagaccctggtgcagctgtctgaggaaattggaaagcttcagtccagcgaggaccagttctcccaggagatagaacagcagcagcgtatccaatgggaactggagcagaaactggagcatctggccgactgcaagacaagggctgaggccctgaaacatgtgctggcggaaaatgaacgcatacaggaggaactggatgccatcgacctggcccaggacaccatgaccaccctgtccacctctatccgcgattcctttggattatacctgaacagggaggcttctgacctgatatccggcatcaccgggggaatctacaccagcatgagcattgacgaaaacttagacgtgttcatgaacacgccgtccaagctggttcccatagaacaggtcagcagcggcaccatggaccagatttatctggccctgcgcctggccgccgccaagctggtccagaacggccggggggataccatgcctctgatttttgacgacagctttgtgctgtatgatgatgagaggttaaaaacagcgttaaaatggctagtgaaggcatatgataaccagattattgtatttacctgccaccagagggaggcacagctgctgacggcaaatcaggtgaagtatcatcttatacgcatataaagcagaaaaacgttggcaaaatcatccatcacagacggttgggcggtattgcggactccccggagtccgttttctgttttcccgcacaaggaaggagccgttgctccatagacatgagttatctatggaggaacggcccctttttaagctagtctttattaatctttgccgcggtcagcgtgatttcaaccaggtaaccgtcggtcaaaacagactgggcagtggttctggcaggcatgcagcccgaatcaaaccaggcatcccaaacagcattaaattcgtcaaacatagaccaatcatggatgtcaatctttgcatagaggatatggttcttatcggagccaaactgttccagcagctcatccaggcggtgggtcagggcagccatctgctcggtcatggtgggctgctttccggcagcgatgtgtccggtaaagtacagaacaccattatactccgttacccttgcaaagtgtttacacatatcatgtctaataatttccattgatatctctccttaaagttttttattttattataaaagttgaacccagtataaaacgctatttcgatttgacaattgccagacggggcagactcacagggttcggttcaaagtttgtcagggtggaacggacgccgaaaatgttctctgagttgtgcaggggaatcatataaacttcttcacgcaaaatgtcgataaccttggcatagtctgctgcgcgctcttctttatccagactgctctgggcagtttccatcagcttgtcgatttccggatttcggatgcccgcatagtttcttctgaaaggaccggtggagtgcatataagggtagtagaactggccgtccttgccggtgggggcaaaggcgcagatgacaacatcatggattcccttgctgtactcagccatcagcgttgcgaattccataatggaaacatcgaccttaacaccgatagcgccccagttgttctggaggatttccgcaaggtcaatacggttctggctttcgttggtccagagcttaatagtgaaaccatcgggataacctgcctcggccagcagttccttggccttctcggggttgtactccaacagggctttatgcttttcaggatcagcgggatggtagccttcattctggggagtgaagaagctgtcgtgcttcctgccggtgccggagaaaacagtgtcaacaatggtatccaggtcaagcgcataggccagggcctcacggaccttcttattgtccagcggagcgaccgtgcagttgaacacaatgttggatgtggtaaaggtatcgcaggtccagatatcgcagttgggattctggcgcagggagtccacggaggtggtcagaggctgcatgcagatatccacgtcaccggcctcgaacgccagggttcttgcggtggagtcggttataatacggaataccaggttcttgaactccggcttttcgccccagtaattctcattgcgctcgaaaacaatgcggtcaccggcaatccactcaacaaacttgtagggtcctgtacctgcgccgttcaaatcccggacaagggcctccggagtcgaactttctatggccttcttgctcagaacgcagtccgcagggtcgctcataaaatcctccatgggagggaagggctcaaaggtaacgatgtccagggtatagtcgtcgataaccttgcatttctccaaatcatacatgttgtagaaggagctttgcagcggcagctcattgccgcgctggtacatgaacaaaacatcctcagctgtcatcttttctccgttgtggaagtaaacgtcatctctcagatggaaccggattgtggtatcatccaggttctcccaggattttgccaggacaccttcatattccatggttgcgtcattacgcctcagcaggccttcgcagtggacctttgaaaccagggtggcggcgctgtcggacagctggaaaatgtccagggatgcaggctcgctggccagagcaacggtaagcgtgtcttcgacggcagtgacaggcagattcgcctgaggcgtattgtctgtgtaggtggaattaattttgtcgcctgtttcaatgataacgccggcctttgtcccggcagactcgccggacacagcactactcccctgctcagacggtgaaccgccgttcttgctgccgcagccagctaatgaacccagcaccatgaccattgccagaaccagtgctaatttccttttcataaatgaatcctccttagattgtatttgtttcttactgaatatgatggcaggcagcaaaatgcccaaggctgtcgccagtcagtgagggatttcttttaaagcattccccgtcagcataagggcagcggggagcaaaccggcagccgggcttggggttaacgggagatgtcagctctcccttcagaaaaatcctttctcgttttacgcccaggctgggaatggggattgcggaaagcaaagctttggtataggggtggcgcgggtccttaaacagctcatcggagccgcacttttccaccacctgacccagatacatcaccataatttcatctgagatgtgcttgacaacggataaatcatgggtgatgaaaatgtatgtcagcccaagctgctcctgcaaatcctgcatcaggttcagaatctgggcctgaatggaaacatccagcgcggataccggctcatcacacactataaactttgggttaagagccaaggccctggcaataccaatacgctgacggcgtccgccgtccaactcatgaggatagcttcctgccagccgtctggccaaacccacaagctccatcaattcatccacacgtttatcaatctccctggctggtaatttctcacagcagcgcagcggctctgcaataatctgcctaacggtcattcggggattcagggatgagaaggggtcctgaaagatgatttgcatgtccgtgtgcagttttttcagttcctttcctctggcattggtaatcttttttccgtcaaaacagatttctccttcggtggtgtccagcagacgtacaatggtacggcccagtgtggacttgccgcagccggactctcctacgattcccagggttttgcctgcctccagagtaaaagacacatcatccacagcatgcagccagccgtcaggcacatggaaatattttttcaggtttctgatttccagtagcgcactcattccaatccctccttttctgcgcaggcacaaagatggcacttgaccatatggcctggagagacttccaattccgctggtttaaccttactgcaaatctccatgcagtgctcacagcggtcatggaacgggcagccgtccggaagattcatcggatcaggcatcaggccttcaatgggcttcagcctgtgaacatctttgtcaatgtttggtatacagccaaacaggccaacggtgtagggatgcctggcattctcaaaaatatctaacagattcccatactccacaatctcaccggcatagatgatggccaccacatcacaattctcaaccactaagccaaggtcgtgggtaatcagaatcatggaggtctgcagttcattcctcagagtacgaatcatatccagcacctgggcctgaatcgtgacatccagggcagtggtgggttcatcggcaataagcagctccgggttgcagcacagcgcaatggcaatgaccactctctgtttcattccgccggaaaactgatgggggtagtcgttgaagcgctccacccttatgcccaccttttccaaggttccctgggcctttgccgcaagttcttctctggagagatgcggctcatgaatctgcagggactccatgacctgctcgccaattgtcatgaccggattcagggaggtcatggggtcctgaaaaatcatggaaacctttttgccccggtattttcgcagggtctccttatccatggcaaggacatcccggccttcaaaatgaatctcaccgctgataatccgggcgggaggctcggacagaagccgcaggattcccagggcagtggtggtttttccggcgccggtttcgcctaccaggcccagagactgtcccctgctcagggccagattcatcccattaacagcttccacaatgccgctgtcagtttcatagtgaatcacaagattctttatatctaataatgtttcgctcataatctgtctcaactccttgcttaacagctgcttaccgtttcattctgggatccagagcatcccgcaatccgtcgccaagcaggttcagcgccagaataaccatcataattgccagaccgggaaacagtgccatataccattcattcagcagatacgccttaccggtgttcagcatactgccccattcgggcgtgggaggctgaatacccagtccaatgtagctcaatgatgcacaggtcagaatcgcactcgcaacgcctaacgtggaacggacgatgatgggggccagacaattgggaagaatatggcgcaggacaatccgcaaatcactggcgccgccggcccgcgcggcttcaatatattcctggtccttaacggtaagaaccgaggcacgcacagtcctggcataggagggaatcgtaccgatgcctgccgcaatcatcaggttaactaaaccggagcccagggcagcggcaatggaaattgccagcagggtgctggggattgccatcagaacatccatgcagcgcataatcacattatctgacttaccgccgtagtagcctgcggccgcacctaaaagggtgccggtgatacaggcgaatccaacagcgataaagccaaccacaatggatgttctggcaccatatataatacggcttaagatatcccgtccaaagttgtctgttcccataggatgccacagattgggccactgtaatgcttccgcaggacgctgctcatccaaaccatagggagccagaagagccggaaccagcgcacagcacagcagaatacatataatgaccagtcccatcatagccttcttatcccgtttcagacgaatccaggcttccccccactgggaggttccatatttttttgtgactctgcggggttttcccccggtcgttgctttcatcataaatcagacctttctttgcgtgtgttatttgccagaaaccggtcaggtctcactttgggcaatgaggtttttaatctttcttttggtctggtaaatggatttcagtctgggatccacaaaggtgtatataatatctaccagcaggttcaaaagactgaacatgacagcaattacaaccacagctccttggatagtcggataatcacgggctttaatggactgaatcatcagcatccctataccgggaattgcaaaaaccgtttctgtaacaatggcgccgcccagcatactgcccagctgaatagcaatcgctgtaatgattggaatcatcgagtttcttaatgcatgggaaataatcacttttcgttcggtctggccttttgcccgggcagtccgtatgtagtcctggcggataacctccagcatactggaacgggtaatcctgactagcgatgccatggcgccggtaccgatggtcagaaccggcataaaccagtgggccggtgttgtaaacccgtagcttggaaaccatcccagcttaacggagaacagaataattgtcattaagccttgccagaatgcaggcattgccacaccaatcagagccagtaccatcagcagattatcaatccaggtattctgcttgatggcggagataattccaatgggaatggaaagaatcaccgcaaatgccgcgcttgttaatgacaagagtattgttgtaggcagccggtccatgacctcctccaaaacaggacgctttgttttgtaagatgtacccaaatccccgtggagcacgatatttttggtataattgagaaaccggaccgggaacggcttgttgagtcccaggtcttcccgaatctgctccacaacctccaccgaggcagcgtcaccggcaatcatttccgcaggatctccgggagaaatctcgttcatggtaaacaccaggaacaaaactcccaggagaaccggaatcatcatcaaaattcgcttaaagatatattttagcacaaatcttcacccccttcattctgcatataatattgacgtaaatcctgtatcattaacgcaccttaattgtagattataacagtggcaagataaactcagtattttatgatttggttgaatattttcattttctattcaaaaaagcatgtacatagtatataatggctaaaagcagattggatgccggagcatgaacaaaatacaggggggcggtatgaaaaaggatttaataaaacggaaaagtctgtccgtcatggaacggcttatgaatcagagtctgaccgtaaaaatcagcgtttttatttacttaatcgtaatcattctctttttatttctctcttttttcctttttgacattgttgggcgggcatctgaccagcggctggtagaggagcactccaagatgctgaaggttgccattcttaccattaacagccgccagcagtatatgattggtgtggcggattattatgccctgtctccggaaatccagaatatgatgaccatcagcaattccggccttcctgtgacaacagtcctggacgagtccaggttcaaaacccctacaatcatcattctcagcaccgtattctataatgccgaaggcgaggccatctactataccacgaaggatacctcccgggcgcccatcaatcaaaaaaacagcggcgccttccagaaactggaatcgggacaggccacctatgtatgggagtatattgaccaaaataacagcggttttatgaaatacgatttttcccccaagctgtgtttgtggagggtagtccgggacagcaacgatgtacatataatcggagctgtggcggttaccattgattcccgctccctccttggctttgacgaaaccgcaaagcagctgtctgaaaacctggcaattatcaattcccgagaccaggtagtatacaaccgttccaatatcaatctgaatgaggatgatatccggctgttatccagcaactcctttggcagcgatacaggcctttataccgctgatttaagcagcggcaggtaccgggtcagctatcaggccattccttccactgattttgtggcgttcttcctataccgccataccccgttcgcctttgggattgatgtcgtatacagctatatattagcgggtttgtttctgtatattctcagcctcttcccgtcgattatactggtttccaaaatgattacaaaacctctggtgagcctgacaaaatccatccagcaatttgcagaggggcagcgtaatgtaaaagttcagtttaaatatacggatgagattggcctgctgggaaaagccttcaatgacatggttttggataatgaacgtctacggatatcggaatatgatttgcgcttaaaaaataaggatgcggaactcgcgctgatgcaggcgcagattaatccccattttctctacaatatgctcaatgcaatccagtggcaggcgctcaagggagggaacaaggagattgcggacatcgcctattccatggctcaggtattccgcatcagcctgagccgcggcaagagcattatttcagtgaagcaggagcttgacctggtcaactactatttatccctgcagcaataccgtctgggcaaaaaaatagactatcatattgattttaatgaggatgtccttggctgccagattccaaagctgattcttcagcctctggttgaaaattccattgtccatggaatggcaaaggacgcttccctcaatctggtgatttcgctgtctgtctccctgtcggaggatggaacgtcgttacactttatgattcaggataacggctgtggaattcccccggaaatccttcggtatttacctaacgaagtaatcccggcttcagcggaggatggtctgaaacccaataagagcagccgctttgcggttaaaaacatttatgaccggcttacacttgtatatggaagcgattttactttccgtatccgcagtgaccacgggaccaccattgagcttattcttcctgtaaaagagatagatgaaaggagcgcttccaatgcttagattggcaattattgacgatgaagaagaaacccgacagattatggtcagttttattgactgggaaacctacggaatcaccgtggtcggagaggcctccgatggtttcaccgcctataatcttatcaactccatgcgtccggatattgtcttaattgatatccagatgcctggaatgaccggccttgatgttctcgaaaagattcgttcagagaacctgatttctcctgcctttattataatgagcggatacgatgacttcgaatttgcccggagggcaatcagcctggcggcggtagaatacttgttaaagcccttccgccctgacgatgtgataatggctatccaaaaatccatcaagcaccttgagcttatccgcagcagttacccggaggctccggctcctggcggcaggaaaaactcattgtccggcaatgccatcgacttttcactgcttcactatccttcccgggaagaacaccgcctgctggagtgcttgaaagttggtacaaaagaaggtgttcttgcggagcttgactgtttctggaactgtctgtgtgaattaaacagtgatactgagagccggctgaattgcgcggtcatcctttatgtagaggtttgccggttcctgctggaacgcggaagctgtttttcatctccatattttgaggatttggatagctccggcgggaatatttcccaggaaatccaccggactctgacatccgttgtgctggatgctctctcgctgcttgagtccggggatgtttcccgtatttatgtaaacaaggcagttcagtatattcaggcccattataaggaaaatctctctctggacagtgttgccaatgaaatcgagctctcgtccccctatctgagcagcctgttttccagaattctgggaaccacctttatcaactatgtgcagtctgtgagaatccagaaagcaaaagagcttttatgcggcacaaccatgaaggtctacgaaattgcctactgcataggctatgatgatgaaaaatacttttcgcaggtcttccgtaaaacagaaggaatcactccttctcaattcagagcccaatcctccgcaaataccaaccgtatgtagcacagcaggaccggaagttttttaaggaattttgtaaaatattaaacgataccaaaagattttccgttcatcttccctggaacgcgatgtaaaatataatcatgatatatctgtacgaggcaaagccacaggaacgtcggtgctgtgacccacggcaggattataattatcagtttattaataggaggatgaataatatggtacgcagtgagaatcaagtagcaaaccctgtacgaaccaacattgaactgtctgagaaggtcctgaatctgaataagcagctggcccagaatcctgagaatgcggatctttggattaagcgcggtctggccctggtagagcagaacctgatgcgggaagcggtagagtcctattccaaagccctgtgcctggagccttttaactggctggcataccgcaaccgcgcacaccggcatctgtcctgctgggaattccaggaagcctgctctgactttattatgtctaccagactggttcccaacacggttgatatccatgaaatctgggaggcctggtatctgctggcactgtcccactatctgctgggtgaatacgaaaaagcggcagacgcctaccagacctgctacggcctggcccgcggcgatgacattatcactaccaccggatggtactggtctactctgatgcgtctgggccgcaaggaagaagctgagaagattttggcgcctataacaaaggagacacaatttgaggcaagccgcgaagcctactttagcacacttcgcatgttcaagggctgggtttcccctgaggataccgaggctcagtgtaatatgcctgactgcaaggataagtttacccggctgtatgccatctccaactattactatatcaccggcgatttggagaattccaaccgcgtgattgaccgtattctggaagaggccggccctgaatggtggatggtctttggctacctggctgcaatggttgacaaaaaggcccgcagcaacgcctaatattatctctctgatatgactcagaatttgctccggcattgtccgggaaaccgttgttttgggaaataacacggctctatacaaaagggcggttttgatgccacatatcaaaacagcccttttctgttgcgctacagagcaggaatacgcgttataatcccaatgtccacccaggaggtttttcatgatgaacaagaacactgaacatcattccattcccatagggcctaccgatattctgcaatttcaaagcctttccaacctgtctctttctttggacggaacccgcgccgcatttatgaagcatcagtgcagcaggacccaggatggatatgattctaatctttggatatatgatttaagccgcagccgtactgtccaggtgacttccggcaacaagaaacaggtgttttgctgggccctggacggctcacttctctatgccacgcctgacggcgaaacccgcttcactaaaatgaatccagacggcagcctcagtccggcatttaacatacccatacaggtcagggccattcagcccataacggataatctctggcttgtggaggctgccagctatgtaaatgaggaggcaaagggcctgctgacggaaaaaatctgcgtggtcctggaggagctgcctgcccattacaatggcgtggggtacacctccggcagccgcagcagcctgtatttgtttgaccggattaccagctcactccggcagattactcctccccactttgaaaccatgggctacagtctgtgtatgaaggagctgaaaatcgtctgccatggacatgagtatacagatgtccgtggaatcaggggaagtatctatctctatgacattcctgccaaaaccggccgaatggttgtggagcccaatatctaccgcctgtacttcgcctccatgatgggacagaacctgctgtttgccggtacaaagggaaaccatgacagcaatgaaaatcccacattctatacactgaatcttgccaccggagaagtatctgagctctgctatcctgaccactatgtaggaggactgggcatcggctccgactgccgctatgaaaccggcaccacctgcctgtgttccggcagcagcgtatacttcacctcagcacattttgaatccagccacctgtttcaggtaacatccggcggcagcttccgacagataagcagccaggaagggtccgtagactgttttgacatcaagggagataaggctgttttcgtcggaatgcggggcatgggcctgcaggagctgtatacgtttaatctggccacgggtcaggaaaccagactgacacatttcaaccaggactatacggacagccacagagtctgcacacccatcccctgttatttccaaaatcatgacggcattaccataaccggctgggtaattcctcctgcagattatgatgaaaaccgtacttaccctgctattctggacatccatggcggtcccaaagcctgctatggtatggttttctaccatgagatgcagctttgggccaatcaggggtactttgtattcttctgtaatcccaggggaagcgacggtcatggagatgcctattctgccatctccggcatcaacggcaccctggactatgatgatttgatggaatttaccgaccatgtcttggaagtatatccccaaatcgaccgaagcagggtgggcgtcaccggcggctcctatggaggcttcctgaccaattggattgcaggccatacaggccggtttgctgctgcggcaagccagcgcagcatcggtgactggatggtgcattatggtgcctgcgacagcggtttctgggtcaccagtgagcagtttcccccttcaccgctgtacgatgccgcaaatgcctggaaccattcccccggaaaatatgctatgaatattaagacgcccatcctcttcatccattctgatgaagaccgccgctgccctctgagtgaaatgatgcctgtttataccggtgcagtgctggcaggcaccccggtgcgtatgtgcctgttccatggtgaaaaccatgaactgtcccgtgccggcaagccccgctgccggattaaacgcctgacagaaatcacaaactggatggacaaatacctgaaaggagaaagaaaggcatgaagcaccctgaaatattaagtctgcacaacatatcgaatctgcgcatttctcccggggcaggccgctgcgcgttccttgtccatactccctgcgaagcagaaaataactatgtaacacacatacatatcagtgactttacccagtcttatccccttggagtatccgggattacaagctttgcctgggtggatgaagccacactggcggttgcccgtcccaatggagacagcacgcagtgcgcacttctgtccctgaagaacggtttggaggagactgtgtgggaaatccccttttccgccagaattgaaggctgggtttccgggcggcttctcatctcagcccgccgtccgattacggaagaaaaggccggggaggatggagcgtggaccatcctggatgaatttcccctttgggaggacggcgtgggataccgggccaagattcgccgccagctttttctttgctcctgcgatggccggttgaaacgtatctctccggagggcatggatgtccgtattgtatcggcagatttatgctgtctggtctatgccggctatactcccggaatccttgccggtgctgcaaatgagattcactattgggacggagaagaccgggtcctctgtaaaaaccatggggaaatcaaacatcttgctgtaggcagcaattatgcgtttttttacgcggctggtattggcagtgaggcggatgctgctcctgccctgatgcaggtttccctgcacaccggcaatgccggaatcctgtatgcatccagaattgcggttggcaattacattgtttccgatgtctgcctgcaggaaaagactttttgtgcggatggtgataatctctattttgccgccacagagaaggggtcctcccagatttataagctggctgccggaggtgaaccgctgcccttgacccttgacccgggcagcattaaccagctggacgtccgtgccggacgtattgcctttgccggtctgcgcaggggagcctgtccggaggtctatatcctgaaggatggagagcagaaggtttcaagccttcacaatgaggacctgcttccctgccaccccatggtggaaatcccctgccatggtattcagggctgggcactacgggaggaaacagatgaaaagacttgtcctgcggttttatttcttcacgacggtcctcagcaggcatttggtgaagtataccactttggaatgcagctgcttgcccaaaacggctatgttgtactgtttgccaacctgcccggcagcatggggtatggcgaagatttttcaaagctggacggacactggggcgattatgactacaacggtcttatccgtttcctggatgcggctctggacgcctgtcctgagattgattccagccgtatggctgtgattggcactggctacggagcttatctggctgcaacagccacggggaaatgtgaccgtttcagagctgcagtctgcgatggggtcatttccaactgtgtttccatggtatcaaccagtgattacggcattgaatttgccgaaaaacagatgaaagcctgtgctttccggcaaaccgccaaactgtggacgcgttctcctctcagccgcatcccttccatgaaaacgcccaccttgctgctccacggcgaaaatgaccgccgcagtcacctctcccagggccagatgctcttcaccgccctaaaggttcatggtgtgccagccagattatgcgtgttccccggccaacatcacggccttgcaggcagaggaacgcctctggcacgggaccgctactacagcgaaattctccggtggctgagaatgtatctgtaacaaatatatttggtcttttctgtgccggataaccggcagaattaaataataatgagaaagggcaggaggaaatcactatgctgctgattaaaaatggacttattcacaatgccgtccgccggactccttttatggctgatattctggtggataacaaaaggattataaagattgagccggatattgtccgggatggcgcagaagtatatgatgcagccggggcagagatttatcccggctttgtagaagcgcatgcccataccggtctgtccggatacggcattggctacgagggacatgactataatgaactgggggacatcatttccccccagcttcgcgccatagacgccattgaacccagggatgaaaccttggcggaagcacgaaatgccggtgttacaaccctctgcgtgggcccgggcagtgcaaatgttctggggggcacctttgctgccatcaaacccgttggatgcagggtggagcagatgtgtcttaaagaggaggctgccatgaaatgcgcctttggtgagaatccgaagcgctgctaccaggaaaaggggaattccagccgcatgaccactgccgcccgcctgagagaggttcttttcagagccagggagtatgaagccaggctggacagggccggagatgatatggcagcccgtcctccctttgatatgaagctccaggccatgctgccggttctccggaaggaaattcctctgaaggcccacgcccatcaggcaaatgacttttttaccgctctgcgcatcgccagggaatttgatgtcaatattacactggaacatgttacggaaggtcacctggttgcagaagaactggctcaggaaaatgtaatgctggccgtggggcccaccctgggtcatgccacgaagtttgaactgagaaacaagacctgggatacgcccggcgtactggcggccagcggctgccatgtttccatcattacggatgctccctttatcccccagaagtatcttactctttgcgcgggtctggctgtgaaggctgggatggatgagtttgaggcgctgaaagccatcacgattcatcctgctgaacatattggagtggcccaccgggtaggctccctggaagtgggaaaggatgcggatattgtaatcactgacggaaatccctttgaaatcgaaaccaatatcctctctgtatttattgacggaaagcaggtattttcccggaatcaatagcattgccgtgccgccatcatcccttcaggcatagagcgtctgagggcactggctcaagaaatatggggctgcggcaaaatagatgggtgattctctatggcgcagcggctccttccttatgcgcgaaacaaaatacggactccgaagagtccgtatttttatactgacaagccgtcacaagcctatcctctgccctcagcctgtcctgcatcccggtacaccttaatagcctccgtaatgttggacgccgaaccatcctgtataagccgtgaaagctgcgccagtttatccggctgcaggaattcccttcccaggtatggtccataggtgtctgtaatgcgtatattctgctccttaatgctgctctccaggctccgcaggttcgcggacacctcgtccagctcctgcctgagcctgtccattgtatccttatggctggctatgatttcatctgttatgatagtctttgtcacattctcaaaggtgctcagggcatcctttttcctggaagctatttccgacagctcctgctccacacaggcaatctcatcgtcatacttttcaaggtcgtatatatcctcgttcccatccttctgaatggttctggtaatcacctttatcttcttctggttggacctcagaacattgcggatatcccgtccccttttaagcgtgtcctggtgacggagcctggtcctgtttccaatcatcacataaaggccgccgaacaacaggacgtccacaaaatacacagccgccagataccagataatcctctggggaatcagaaaataaatgccgcagggaattcccaaaaagcagattatcagggtaagcaggaatatcagtatttccttaaatcctctgggatagtacaaggcataataaaatgtagtcccgcaccaggcaggcacccggttcttctggaacaatgtcctcagctggaccttcaggtccctgttgtgttcccgcagttcgctggtctcctcggcaatccgttccttcatcccctggctcttggccttctcccgttttgccctggctttcttaagacgttcctggccttttccaatctccttgtcatagctggaattaatctcatccaaacgctttttaacggtctggttcacggaatcggatacagcctttccggcagtttcaagctcccgttcttttttctcttcttcatccgccagctggccggccgtattctggtcacagttaagacggtacaccgcatccctggcatctgccaggaactttacataatccgtaattgcctgtcccacctgcatttcctccttatgggaacgtttgttattacgtatagcttactacaaatagtccccacgggcaagggatgttacaaaaaattcaaatatggccgaaatatgacggatacagtcacagccggcattgagtttaaaaatgacttttaaaacatcggattagatgttatactaaaacatcagaagccaatgtaacagacttgcaaaaggagaagcactatgttcagaatgtggggaaaacttatgaaagacaaccatctggtcaaggacacggtggcagtcatgactgactactcacggtccaggacccagatggtatttgactctttggattctatctgctatgagtttgacctggaaaaaccaatctggctggaatcttctgttaaggaattccagcttcatgataaggtacggtttacccaggataattttatagaatccattgactttgattttttggaaatccaggtaattgaagagtaatatccggcctgttttaatgctccgccatgtggcagcatacctgatgtccgggcgacaccgtatacacaggcggctcttcccgcctgcagatatcctggcacatcagacagcggttggcgaatttgcagccaggcttgggattaattgggctgggcacatccccctccaacagaatccgttccctcttatagccatacttggcaatggggaccgcggaaagcaacgccttagtataaggatgcacgggattcttaaagagctccctggaatcgcatatttccaccatctgtcccagatacattactaatatccggttgctgatatggcgaaccacactcaggtcatgggatatgaacagataggtcagccccattgtgctctgaagttcctggagcaggttaagtatctgggcctgtatggatacatccagggatgacaccggttcgtcacatatgatgaattccggattcagggccagcgcccttatgatacccaccctctggcgccgtcctccgtccagttcatggggatagctgttaaataattttctgctgacaccgccctttgccatcaaatccagtaccctgtcattaatctccccggccggatatgtcttatgtatacgcagcggctctgcaatgatttgtccgatggtctttctggggtccagacaggaataggggtcctgaaatataatctgcattttctttctcaatccctgcatcttcctgttatcataggaaagaatatcctccccctggtatatgacctggccgtccgtatgcggaatcagacgcaggaccacccggcctaccgtggattttccgcacccgctttcccctacaagtcctaacgtctcccccttatctatatggaaactcacattatccactgcatggagcgtacctgcaggcaccttaaagtacttcttcaagttgtgaacctctaaaatcgtatcactcatactgttcttcctttctgtataaatgacattttacagtgtgctccccgccgatggacatgtcctccggctctgttgtcctgcatatatccatggccttgtcgcatctcggacaaaatttacatcccgcaggcaattccatggggtcgggcatggaccccctgattacgtgaagcatggcggactcctccgactcaatatcagggagacatccgaacagtccctgtgtatatggatgggacggctgttcaaacacttcctgtatggttcccttctcaatcacacaccctgcataaacaactaccacatagtctgcaatttccgccacaacccccagggcatgggtaataaatatggtagaagtcttatatttctccttcaggcccttcatcaattccagaatctgggcctggatagtcacatccagcgcagtggtgggctcatctgcaatgagaagctggggattgcaggacagtcccatggcaatgcacaccctctgcttcatacctccagaaaactcatgaggatagtttgtgaggcgctccctgggaatccccacgatttccagcatatcgccggcccttttccaggcctccttctggtctacatcctgatgctgcttgatgacatcgctaatctggtgccctaccgtgtaaaccggatttagggatgtcatggggttctggaatatcattcctattttctttccccggtactggcacatggccgactcattcagcttcagcaaatccgtgccctcaaacaggatggagccagatgtgatgaccccgggcggatttggcaccaatcccatgacagacagggccgtggtggtcttacctgcccctgtctcccccacaagtcccacggtctttcccctgggcacatcaaatgacatgtggttgattgccttcaccactccgtcatatgtgcggaattcaatgcttaaatcttttatttcaagcaggttctcgctcatatccttttcccctttcagcggctgtactgccaatcacggacagccgcacaaatctttcaggctcatgcctgcctcttttttgccagataatacggcaatgctgccgatgtacggattcccttgaaaaatccgctcaaaaccatactttcattgggtgcatggttcttttggtctgccgcggcatagggaatcacaatactgggaactcccagatggccggtgaacacaaaatccggagccactcccccaattccggggaaaataatgggttcttcctcaaacccgtcccgcagggcctgggctgccacttccacatacggatggtccaccggcgtccttgacggggtaaccatcccataatgcttaagctctgcatccttaaacccatggttatccagatgacggcgcagtgtcctgtatatcttttccggagtctgtcccggaaccaggcgcatgtcaatctttacaaccgcttcccttggcagcacggtcttggacccatttccggtaaaaccagatgataatcctgcaatattgcaggtaggttcaaatataagattataatagaaattatctgacttccttccccttataaaatggtccactccatattgtttctttaagacctcttcatctgacggaatcttagatactgcatctatttccagctggctcagcggccttacatcatcataaaacccatcaatggtgatattgccctctgcatcccgcattgtattcagaagctttaccatcctccatgcaggattctgtatacaggtcgccatcatggaatgcaggtctgtctcggcttccctcaatgtaatctccgcatagcaaagaccctttacacctaagttaatctgcggcctgccgctttcatgatagtggctgtccgaatagaaacatacatcacatttcaacagttctttatggctttccacaaaggtcagcaaatcagggcttccgatttcttcctcaccctcaaaaaggtactttacattgacaggaagctttcccttcacctctgcccatgcctgggcagctttaatatgggtgaaaagctgtgacttatcgtctgatacgcctctgcagaatatcttcccgtcccgtatatccggttcaaacgggtcgctcttccactcctccagaggttccggcggctgcacatcatagtggccatataccagcatggtgggaagggatgcatcttccatgcgctctccatatacaatgggatgcctgtccgtgggaaaaatggaagccctgataccgcttttctccatgattccggcaagaagctctgcgcattcctccactccctcatccctggtgcttatgctcttacaccgcaaaaatgtaaatagttcctctaaatacgcttccttatgctgttctatgtaatcgaaaatctctttcattccaatgcctcacattcattgtctgttttatcagtcactcttaagcttagggtctaaaatatcccttaagccgtcgccaaacaggttcagtcccaataccaggaaaaggattgccagaccaatgatactggtcacatggggggccaccaacagatactggcgtccgctggacagcattgctccccactccggtgtgggcggctgggcgccgattcctaaaaatcccattccggatgtagttaataccgcatttccgaaattcaaagtagccagaacaattaacggcgacataatgttgggcaggatatgtgatacgataatccggaaattgttggcgcccagggctttggctgcctcgatatattccccattcttaatcgccagtgtctcgcttcgggccatgcgcgcaaaattcggcactgtatagattgatacagccatgaccgcattagtaagattggcccccagcactgccacgaacaaaatacacaggagcagctgcggaaatgccatcagcacatccatgatacgcatcagcatgaaatccatctttcctccatagtagcctgacacgatacccaggggcaccccaataaaaaatgcagccagaaccaccgtaacgccgatgccaattgaaattctggccccataaacaagacggctcaggatatcacgtcccagctcatccgttccaagcagatgcccttctatggtccccggggctttcagcatgatgctgaagttagcctcctccgggtcataaggagcaatccaaggcgcggcaattgctatagccacatacagcagtacaatcaccaggcctaaaacagcgatttttctctttttaaaattatgccagaagcgcttaatctgatacgatttggaaatcttgatatccgcctgcaaagcgccttcagctgctggattctctgtcttctccggcattcgtctccctcccatcaggacaatttgattcttggattgatgactgcatacagaaggtctacaatcaaattaacaatcacaaacgatgcggcaataaccaggatggctgactgcaccacctgaaagtcccttgccttgattgacgtcacgattaaatctcccaggcccggccatccgaataccttctctgtaatgacggctccgccaatcaaaaggccaaactgaagtccggcaaccgtcacaatggcattcatggcattctttaacgcacatccgaatatgacctttcttttgctgaatccctgggccctggcggtctggatgtaatcctgacccaatatttccagggtactggagcgggtcatacgggcaatggtcgccagacttctggacgaaagagtcaccgtaggcaaaatcaggctcagcgcagtggactggggtgtaataggaagccattgaagcttgacacagacaaccagcatcagcatcagacccagataaaatgccggtgtggaaaggcctatcagggccaggaacatacatagattatcccatatggaaaaccgtttcacggctgacagcaggccaatccctacaccgcctatgattgccacaattgtggatgtggctgccaataaaagagtatttggataacgtactgccagctcttctgccacaggccggccggttcttgtagatgtgccaaaattcccctggagaatacctccaacatatttaaaatactgtacgtacagaggcttatcatatccatacgccacccgaatccgctccacgtcctccgttgtagcctgctcacctgctattagccgggccgggtcgccgggcatcatatgtaccatcagaaatactaaaagggagactacaataagcactggaatcaaagacaacattcgtttaaaaatatattttgccattgaccgccctgttcctttcttaacttccctccccgggatacatccgggggagggaaccatttttttatattgcatttacagattacattgttctatatcctgtttttatcacattactttctgttcagatatgccagttcaattgtctcattcggatagataaccagtcctgatacgtctgcccttgtgccgaatgtctggttctcataatacaggatgacggacgcccggtcctcatggatgatgtcctgcatcttatacagcagttccttgcgggcagactcatctgccgtacgctgctgctcctcgcataccttgtcatattcagggttggagtagaatgtatagttctgaagctcccctgacctgtaattatacataaggtcctgggccaaatctccggttgcgcatccctttcctaacaggaagatttccgtatctccggcagctgctgcttccgtataagcgccccagtccagaacattaacctctgctgtaatgcctacctgtgacagcatggcctggatggcttctgcaacctggcggtccattgcatacctgccttcaggagtattaatctttgtggtaaatccgtccggataaccggcctctgccaataactgttttgccttttcagggtcgtatttataatcgtctccaattcccggttttgcattctggattgaagatgagataactccggtagacgggaaggtcacatatccccctaaaatgccattgatgatggcgtcgcggtcaattgcatagtcaattgcctcgcggaccttcagatttgcaagcttctcatcctggaaattcagtcccagataaatagtgcggtaaccgggaaccatctccacctcaacattggggtcgctctgaagctcatccactaaaacacttggaatgttagctgcaacatctgcatcacctgtcttaagcatcattgcccttgcagaatcctcggcaattatctttatatcaatggtttctgccgttgccggggtcccccaataggtttcatttttctccagggacatggaagtgcctggaatccactccttcagtttaaggggaccggtgcccgctgcatgggtgctgtaatccttcccatactcctccagggccttcggactcatcatgcccgtactgtatgtactgaccatggccggaattaccgcgcagggctggtccaggataaatttaatttcgtggtcattgacaatttcaaaatccgtaatcatattcaccagggaagacttgggtgagcctgttgcagggtccttaagacgctcaatattgtatttcactgcctcggcattaaagggttcgccgtcatggaacgtaactccctcccttaacttaaaggtccactcggttgcatcctcatttggggaccattccgttgccagtaccggctggaaattgccttccaaatcccgtttcaccaggttctcatgtatctgcacagatacacggccggtatttgcatcactcatgagatgggtatccatggtaaggggctccgtacctatcacatacgtaaaatgattgcctgccgtggactggcctgccgtggactggcctgccgatgcggaggcagttgtatcggctgtgccggctgcctcccccgtacttgtctggttactggctgtcccggagcatgcgctcaaaacaaacagggatgccatagccattgctaaaacctttactgttctttttttcattgtcattcctcctatgattttatacagagccggttagggcctttcttggatacttatataactagcaaatcacatgccaacatatatataattacacaattcactgcaaatagccataagctgccattaaattgtgactgattaaagaaaattatttttcaaatccttcttgtgtttttcgcaacagtgttgtagtattgaagcaacgttgcgtgcgttgcatcatccaggaggtactttatgctgataaatatcatttttattatcccctatccggaattggaggaaagggtcaacaaaattttccagaatcaccccctccgggcaaggctgagaaaaagaatcgagatgcgcacggccgatgagcttgaaacattttcatttaacgcccacagcgatgtcattatagcccgcggctacacggcctgcggcctgcgcaggatgaccccggaactccctatcatagaacttcccataacggcctatgatttgattcgggctctcaatgagtgtatcactctttattcacccaagaaagtggcatttattggaaattataccgcccttgcggaggcggatgaactgggcagctttgtaaactgtgatattaaaagctaccattccgaatccacggatgacattaccaaagcaattgaccaggctgtggctgacggctatactgccttcataggcggatattccgtcaatttaatctgttcccagaggggacttccatccgtcaccatacgcacgggcaatgaggccgttaccagggccctggacgaggctgtgcgtaccgtggatgtggtccgtatggaacgggaacgctcggccatgttcaccaccattacccagacagccatggatggggtattatatgtggatacacagcagaccataaaaatatgcaaccccgctgccctgaagatgtacacagggccaaagaagaagctccagggtctttccctgcagtccgccttccccttcctctcagagccggtttctgctgtcataaattcgggaacagagcttcccaaccagctcatacggtggaaaaactacacaatcaacgccaccatccatcctgtcattatcaacagccgcataaccggtatcgtggtaaccttccaggatgtaacacagattcagcaggtggaaatccagatacgtaagaagatgactgataaagggcttaacgcccattaccactttgatgatattatccatgaaagcccggaaatagattatgtaatcgaaaaagcgaaaaagttcgcttctgtctcctcaaatatccttatagagggggaaaccggcaccggaaaggaattgtttgcgcaaagcatacataatgccagcacccgctgcaacggtccatttgtggcagtcaactgcgccgcactgccggaaaacctgctggaaagcgaactgttcggatatgtggagggtgcatttaccggtacagccaagggcggtaaaaccggcctctttgagctggcccacaagggaaccctgttcctggatgaaatttccgaaatccccctcagcatccagggcaaactgctccgcgtcctccaggagcatgaggtccggagggtgggcggggaccgggtgatttccgtggatgtacgtatcattgccgccaccaatcacagcctgagccacataacagagcaggggcggttccgccaggaccttttataccgcctgaatgtattgaagctgttcctgcctcctttgcgcaggcgctgcggcgataccaagatacttttcctccattatttaaatctgtattaccggcaattgggcagaatcatcccccatgtggccacagcagccatacagatgctgtctgattaccatttccccggaaatatccgcgaattgagaaatgtcacggaacggctggttgttatatgtatggataaagaagaaataacgtcagatgatatgcgggaggcgctgcatcccgaagagctgccggcaaaattccagtccgcggacacgcccattccgcctttttaccaggatggggagcgtgaattcctgattcggatgttagaagaatcaaattataatcagaccctgactgctgagaagctcggcattaaccggacaaccctgtggagacgcatgaaaaagcacggtatacggcggccttaagacatctgtaaatacagtgtgtatcaactttataccacaagcggagggatatcatgaaaaacctatttataatcggagaaatggccgaactcttcggcatcaacatacgtaccctgcgctattatgacggaatcggcatcctgcgcccggagacaacagacccggaaaccggataccggtattactctacccgacagtttgaacggctgaataccatcaaatatctccgggccctgggcgtatctctcaagaaaatttcattgttttttgaaaacagggatgtggatattatgctggcactgctcaaagaacagagggaagaaacacaggcaaaaatcagtgaactgatacagattgaacagaagctggaataccgcctgaaggccctggaggatgccatggacacacaatgcggccaaatcagaatccttcatttggaacagaggcccattgcatatctgcgcaaggatattaaactgggagaggacctggaattccccctccgtgagctggaaagggccaatacgctggaacctgcaatgttcctgggcaaggtaggcgtgtccctgtcatccgctaatctgaaggcccggagatttgaatcattttcaggtatttttgtacttctcgagaaggaggaccactatcagggagaggaacagcatctgcaggccggggactatataagcgtccgcttttccggcacccatcaggaggcgtcccagcactatatactgcttttggaatacatggaccggatgggctattcctgctgcggggattccgtggaaatcaccttgattgacgcgggctttaccaatgatgtgtcccggtatgtgacggaaatacagattcctttttcaagaaaatcagaaaattagacatttcttattgaccctctagttactggagggtttatttttatacataacaaatgttagattgaggagaggttcaacatgaaaaacagtaatctgctgacagaaggaaatgtatttcacgtgctgctggcgttctctgtcccatttctggttgccaatgtgatacaggccctttacggcgctgtggacctgatggtcatcggatggtactgcccgccggagagcgtggccgcggtttccaccggaacccaggtcacccagattatcaccagcatggtatccggcctgaccctgggcggcaccatactggtgggaaaatacaccggcatgaaggatgatgaaaggacctgccgcaccatcgggaccactctgtccgtatttgcggttgtggcattggcactgacctttggaatgctgattttcagggacaccatacttgcagccttaaagacgccggccgcctccatggatgaagccaggcagtatgtgaccatctgcttctgcggtatatttttcatctgcggctacaatgccatcagcgccatattaagagggtacggagactcacgcaggcccatgtattttgtggcgctgtcctgtgtgctcaacattgcaggcgatattatttttgtcaagtatctgggattgggcgtggccggcacggccctggcaaccgtcctctcccaatccatcagcatgatatgctccattgtctaccttaacaggaagaagttcatatttatctttacccttaaaaacctgcgcattgacagggacaggctgaaggagctggccatggtgggcatccccatctcttcccaggagtgcatggtccggctgtcctttctgtatctgacttcggtcaccaaccgtctgggggtaaatgcagctgcagcagttggcattgccagcaaatacgatgtgtttgccatgcttcccgccacctccatcgccagcgccctggctgccatcacagcccagaactacggcgccggaaaaccggggcgggcaaggaaatccctggccgccggcattggattcgcggtgctggcctcctctgtcttcttcctgtgggcccagctgtccccccggaccatgattggactttttaacaccaatccccacatcatagaggccggaatccccttctttcattcctgcagcattgattacctggctgtatcctttgtattctgtctcaacggctttatgaacggccgttccaaaacagtttttaccatggtcagctgctgtttcggcgccctggccctcagaatgcctctcatatggctggcctacacctactgccctgataacctgtttgtcataggattgattgcgcccgctgtgtccggctttatggcagtgtataccatgttctttgtgatacggcaattaaaacaggatgcccgggcaatcgaaaagccgtcctgctgactcaccccatcagcaggacggccttttctctatgccgtatctctgttaagcttttatctcacttagattcatatggcatgaccggccagtcatcccgaaaccgcaccgtcattacagccgctttagcagttcctctctctgagcctcatatccaggcttacccagcaatgcaaacatgttcttcttgtagctctccacacccggctggttaaacggattcacgcccaggatatatccgctgacaccgcaggcaaactcgaagaagtagaacagctctcccagatagaactcgttctgctccggaatcttaaccatcaggttgggtacattgccgtcggtgtgagccaggatagttccgttcatggcgctcttatttacaaaatccacactcttccctgccaggtaattcatgccgtcggtatccacgtcttctttattcagaagaatctcggcaggagattcttcaacattgagaactgtctcaaacatgatacgtgctccgtcctgtatgaactgtcccatggagtgaaggtctgtggtcaaatccactgccgccgggaaaatgcccctctggtccttgccctcgctctcgccatagagctgtttccaccactcggacacatagtgaaggcttggctcatagttggccacaatttcaactgcctttcccttgcggtgcagaatgttacgcacagctgcatactgaagggctgcgttggattcatatggtgtctccagggctttctgcctgcctgaagcagcaccctccattaacttatcaatatccgctccactcactgcaatcggaagaaggcctacagccgtcaatacggagaaacgtccgcccacatcatccggcacaacgaattcttcatagccttcttcgtctgccaggttctttagggcgcctttagccttgtcagtggttgcgtagatgcgcttgttggcttcttctctgccatatttttcaatgagcatttccttaaatacacggaatgcaattgcaggttctgtggtagtgcctgacttggaaatgatgttgacggagaaatccttgccgtccagtacctgctttaagtcacggatatatttactgctgatgctgttgcctacaaaataaatctcaggtgtcttgcgaacgctcttgggtaacacattataaaagctgtgtgacagaaattcaatggctgcccttgcccccagataggagccgccgatgcctaccaccagcaggacatcagaatcattctgaatcttttccgccgccttcttaatccttgcaaattcggccttatcataatctaccggcaaatcgatccatcccagaaaatcattaccggcgccagtcttgctcagcaaggtctcctttgcactcatgactgtggtcttaaagttggccatctcttccgcagaaacgaatcctgctgccttggaataatcaaacataacttcctttcccataactcgcgctctccttttcttatgtccatggaccatctgcccatgattctatcagtgctgcggtaaagccgcttatctcttaaattataacataatttcccttataataccatttctttctgaccctggaagcaaattcctgggtgtcagcctatttaggaaatgaattctttcagcaattcccccaacattcttttttgttccggatttaaatcctgaagccaattatcctttgacttctcttcctgtttttccctgctggcagcagtttgctccagcccccttctattattactatttgaacggcggtctcttcctatggagcgcagattagccggttccctgcggtcctcctcagctgtaacggccggcacatgctctgctgcgccttcccggttcattcgcggccacatcacattttccagatagtcctggaggcaggtcagaagctgctgtctcctggattccaggtttactccgtaatccaccagcatggtgaacatgccggccaggatgcctgtggtgccgtacaatacaatataataattatcacttctaaaccaataagagagaaatgctgctccgccgcctgccaggaagcagagaagtgtcagctgccccgacaggttgtccagtcccttgacggacatcccaaaggtccgcaggctgtacatctggcgttccagatatacacgtgtgttgttcattccctgattcatacgatatgtatcctctgcattctgtttcaatccgcgcagatatttgttcttagtcaatgccatgttggtgctttctttaattaatcgtttgtagaagcttcctgccatcaacctggtaaatacccctgccaggcagattgctgccagcacgtatagtgcctttcctgtttgtaaaaagctcatcatagtaaaagctcccctttcttcccggattccatcccgtttctatataatattattgttttggccctggctgctggctgcagccgctgcctggtttgggaagcgcccctgcagtcaggcgtttcccggtaaagtctattatagcaacggattttgatttgggaagttgagagtccctagaatcgttcgccaaattctcctaaaaaacgattctgagtggtgagatttttctttagacagttaaggtatacgccaggattttccttctgcatccgtatgcttttcccggccggattcccgttctccatgcttttcccggccggattcctggtccccatgctctttctgattggattcctggtccagccgttttttcataatccagtaaacagccattcctgccggtagaaacaggcggaactccctgctgccgttttcatatgtgacatagcggctgagcctcaccgtagctgccgcccagttgaccttaaactcccgcctggcgggcgtacgtatgatagaaaaccccatggagagataggctatgagtatcaatataatccatccccacctgtaccgcggattctgcctgtaacatatgacggctgtcataatcgtagcggaaatcatggccagggacagaaggaacaatccccactgaaatacattccaatgaccgatggtgcgcagggtgccctggggcgccaaggatgcgctgtccctgacggtaaagctgatgattccccggctcccgtccgatgtctccattctcttaaggccggctgtaaacagctggccgtcctctgccttcaccctgtaggtacattccacagttttggtctttacaccctttacagtactggtccggacatttaatcccctctttttaaaagaggccatctgtcttgcgccccatatatccatattttcctgtatttctttttccatatattcttcgggcactgctcccggcaaatacagggagcgcatggcctcccggtccccctgggatgccgctgacaccatctgttccaggtaatggtccgccgctgtctccttgtcaaagaaatgcgtcacccctttatataggaaaaaggccgcaatgcagagaaacgctgccatgacagcaactgctgttcctccaaatatcatccatttccttttcttgcccataccaacctccctctcttataaaacagacctctgaatttcgtcatatccagaggtctaattattagcgaatctttatatgtgtgtctgctatatatcaatctgattttcaatcaatccttatttaagaaaaggaacgtacaagctcagtaagcagatttacgctgtggacaatggccttagcttcaaaagcaggataatccactgtggcgctgtcatccgccttgtcagagatggccctcacaataaggaacgggatagagttaagatagcaggcctgggcaatggcagccccctccatttccgtacaatatcctccaaacgtatctaccagccactttttcttgtttttatcagagacaaactggtctccggtcactacgcgccccacgaaggtgcggatgtccggatttaccctggcgcagcagccctctgccagatgtataagaccctcgtctgccttaaaggccagtgtctctaccctgggtatctgtcccggctcatagccaaatccggtagcatccatgtcatgctgaagcgcatcgctggaaagtactatgtccccaatatcaatctcagccttcagggaacctgcaattcccgtattcaccacacccgttacgccgtatatatcagccagaatctgagtacacatagctgcattaaccttgccgatgccggagcggaccaccactacctcctttccctccagttttcctttataaaagtccatggcagcccttgtctccacctgcacatctgtcaactgcgccttaatcatagccacttcctcgtccatggctccaataattcctagcataattacctccttctgtcttgtactattcttctattatataggaagcccgcagattttcaagttcaaagcttgttctcacttgacattatcttttgcataaggcataatcggatatacatgaatttattacaggaggcactacacatgagatataaaacacaaggggtctgttccagggagatatcctttgaagtgaaagataataaactgaccaatgtccaattcataggcggctgctccggcaatacacagggcctgtcccgcctcatcgagggcatggacgtggatgaggccatccgcaggctggacggaatccagtgcgggccaagacctacgtcttgcccggaccagttggctagggcgttgaagcagtttaaagggcggtaaaagtgttaaaggaaaggagaataaatatagttctcctttcctttttagtatattacttatcacaattcgtatcttactaatcaatgaaaattcctgctgtaactgggctaaaaccttcaaatttatcattataaacagctgagaatacccctcttaatcgataataataacccttttcctgacctttaaatgtaatgtttactgtaggggtatccaatccttcaggataatcttttgcataatattcagcgtcataatatgttacctgtctccagcgttcggatgtttcatcccatctatccaaataaactgtaatgtatgcctcatctactggtatggctaaaaatccaatagctactgcaccaatatccccattaccttcatcagaaattgctaaatcagctctcataaaaaaatcgccccttgctttagcaaattcagaaaccttactttgtcgtatagactttggtaataattcagaaacctcattaaccgaggtatagtcatttgggttatatggtttagcataaacagttaatgtcgtcatagacaaaataagaatactgctcaaaattgtaactatatactttttcatttgtacatctcctttttaaaatgttaatctctccacaatttgtagaaacgctgattcatcgataacacctgaaatagagtaatatgaaccatctaatattactgatgtatcatatcttaatttttcgttagataacatttctctatggatatctaaattttctccaatccatttattataaatatttaatttatattgggaatcacctttatagttatatgaaactttcttatcgtactttgactgtattagaaaaacattttcttgcttataattaaatttcatatatgctattccattttctatatataaacctaaaaaatccatatccggtggtatataacccaatttaagtggtttgatattcagctcctccccaataacctcataagcctcatcctccccattgacctcagccttaaatgaatcatttacaaaaataccttgtccatcccccaactccttctcccgataaaaatacgacttcgtccccatagccaccatacatccactccctgccacaagacaggcaattaaaccaaccgcagccaaccgcttccagccaaacctcggtctgataaccttggggtgctctggttggttggattccggtacattctttgactcagccctttcttcctgtatccttgtccagattttctcaaattcgtctggtgatggggacggaatgggaagggggacggccatatgcttgactgcttcaaattcttttaacagttcttcatctgatatatcatccgttccccaaatcgggcagtccatagaattgtcctgttctgaatctcttttataatctcccacgtgacacctctgtttaccaaatctcctaaagttccctttgcctttagggttgactttttgcgtttaatgcttactataatagtagacgtttgtgaatgccggattccccagcatatcgtattctttaggaggtttttatgaaaaaaatcattttaaccggcggcggtactgccggacacgttacccccaatctggccctgctcccttcactgaaggaggctggttacgaaatccgctatatcggttcataccagggtatggaacgcaagctgattgaaaatgcaggcattccctatgatggcatatcctctggcaagctgcgcagatactttgatatcaagaatttttccgacccattccgcgttgtcaagggttacacggaggccagacggctcttaaaacgccataaaccggatgtagttttttccaagggcggctttgttgcagttcccgtggttcttgctgccaagcattacaaaattcctgtcatcatacatgaatccgatatgacgccaggactggccaacaaaatatgcattccctccgcctgcaaagtctgctgtaatttcccggaaacccttaagtaccttccatctgacaaagctgtgcttacaggctctcctatccgtgaggaactgctccagggcgaccggctgtccgggctcacttatgcccatctgtccgcccacaagccagtacttcttgtcataggcggaagtctgggctctgtagccgttaacacagcagtccgcaacatccttccccgtcttctgcccagctatcaggtaatacatatctgcggcaaaggcaatctggatgagaaccggattggaacagacggatatgtacagtatgaatacgttgacgctcccctaaagcatctgtttgcggcagccgaccttgtcatatcaagggctggagccaattccatctgcgaacttctggcactgcgcaaaccgaacctgctcatccccctgtcagcagcggcaagccgcggagaccagattctcaatgccaattcctttgcaaaacaaggattcagcaaggttctggaagaggaagcattgtctgatgactctttgtttaatgcgattaacgatttatatttaaaccgcaatacctatattcaggccatggaacaaagcagtctgaacaatgctgttaaaacagttgtatctctcattgaatcatgtgtgaaataaccttagggccaattatctctttttagcagttcttctaggtacttcctgatacggctgactctggaatagcatgccttttctgtaatatccaacatagcgcatacttcccttgtcggccgtccctctatcaatctgagcgtcgcgacctgacgccagttttcaggcatcctctcgatttccttaataatcgcctcgcatctctctttgctgactacataatccggcagattggcagccttatcgtgagccggatactcctcactgttatatgcctcttcgtccaattccccatagctcctgtacttcatcttgcggtggaaatccatacaccggctttttagaatacgtatcagcagcgccctcttactttcctcggccatatccagggaatatttatagcgggcatatgagacaaatgtatcctgtaccacatcctcaatataatccacaggaatatcgttcacataagctatccttctcaggtatacctcatattccagatacatttcctcaaacagtttcttatcttctgaatccatcttctcaatcttcattgcaattacagacagcctttgattttatccgcaacctctgccaattcttccggcgaagcctttcccggagcccaactgaccatggccggacctccttcatatcttggaatcacatgcatgtggaaatggaacacagtctgcccggctgcttctccattattctgaaccagattgaatcccgcacatccaagagatttcttcatcgcagagccaatcttggcacccagaggaagtaccttggcggctgtatccccatccagtgcgcatacatctgcaaaatgctgttttggaagaataagggcatgtcctctggacgccggtcccaaatccagaatcacgcgaaactcttcatcctcatacagagtggttgacggaatcaccccgcccgctattttacaaaaaatacaattgtcatctgtcattctgaaaatcctccttccgctgcggttaacacagcctgcattctatccagccataccggaaataccggcagcacgttttctccgataaagcaggatacctaaaatgaagccggaaatcaggcctcctatgtgggccacattgtccacccctgctgaagtgaacccatgataaagcgtcagcagaaccatgaaacccagctgcctgttggttagtccgtccaactgaccatgatgaatggcaatcacatagaccagaccgcctaccacaccgaagattgcgcctgaagctcccgcagacacactggccgcccctgtccgtacctggacagccagggagatgccgttggcagcaacaccgctggcaaggtaaaatatcaaatatttgatatgaccaagcgccttttccatcttctcgcccagcaccagcagaaccagcatattatttgccagatggctgactccaaagtgcaggaacatggcagtaaacagcctgtagtactctccaccgaggataacaaagggtgcaaatacagccccatgccttaccatgaatactccatcctcagtggagccgatggcttccagatacagaaataccaatacgttgactgctaccaacgcaatattaacatatggcctgttcctgtttatgcctgtaaccatccttattcctcacatcctcaatgatatataatcttaacatactttaaaggacttgttaagtggctttgacgcaataaagttattttttatgcccctcctcttgctatttagtatttctgtgaccatgctcctgcaattggattttttaagtggaaggagaatgccgggccgctctgttctgtcagtgaaacatatatccatggtcggccataaatatctggtctcccggctccagctgtgttgtctcatttgcctccagcagacggcctctgaccctggtaccattggtggaattaaggtctgttacactataatgcccattctcttcatctaatcttatatgaaaacggctcactgtatccttcatgagcacataatcggccaaatccttgtgcttgccaattacaaaggggtaataggatatggtaatatcctcatccgaaccattcagggcagataaacgccggacgtcctccccttctgccggccgttctgataaaagggcggtctgaaagcattcaccggtatttctttccgtcttattttgtaaatttttattttcatcctgattctcatcctcattccggtatatctgaaacggctgattaccgaactccccgtcttcctcctcttcatcctcatacaaaattctccacgggtcctgttcttctcctgattctgtctcttttccctttacagcccttgaggcaatcaacagcctgcatatattaaatgccggcaacgcaagcaataggcctccgtccattgccgcaaacagaatccaattatcaaagaccgctgtcctccctttgaacagccacagcgccaatggagggaatatcacggctgccagccataggattatctggcgcatgaaacgtttcctgcctgcactcttatccagttcactatgcagcgttccatgctgctccttggttcctctttctttccgccctctgccagtctcctgcccctgggtctccttccgtcctctgccagtctccttcccccgcgtctccttccgtcctctgcctgcttcctccccctgtgttttcttacgccctccgccggcctcctccccccgcggttccttctgtcctctgcctgtccccttttcctccttctctaccttctcccaacacgcctgctcccggaattctcccatctccgcagaatcctccggagtctccttaaatagcgccctgtctttcccctttctccgctccgctgcaatcaggcccagcaaatcctccattccgcagttttctttaaggctttcctgatatagcccataagccaggactacgctctcccggtctttgtggtttatccttttcagaatatattgcaggagccggctcagcttgtcctgaaaatccccctgaacaccgggcaccagacacaaaccggtctggaacagctccggttccacataaatatattccggctccatcaggaccccgccagcatccaaaaggtactcttccataccgtttaatgccccatgaatctgaatcaacagctggcatatctcgtccctggttataaaacgggtatccagcagccggcttaggggctgtctggatgtaatgtcatagcaatatgagggccgcccatcctgatatgttatatacattctcagcagtccccgaatctcattgtgggccagcattctggcttcatatcccgcctcatagccaggttcattccctgtcggccctgctaccagataattccgttttgcttccctcctgtagctaatttccatcatccctgaccagcccttcaattaaagtaatcctgcgcaggaatatctccgggcggaatacccccgcatcaatctccttttcccatgttccaccgctgccttttccatatatcctccgtcctttttcctttactgtcagactgcagtcaggaaaggacatcaggcggcccagatgattccgggcagcagatacggtagactccagttcctgcacacttccatggcgtcccctttccactgcctcatggaggcccatggcagccttggtttcatcatgaatacgtcccccatgctggagcatcagcgatatgcacagcaataccatggccataatccatgctgcctcaactgtaaggctcccattcagtgtttttcccttcatatgaacatcaccccgattcctgcgggaaccaggaatggaagaaaaggaatgcgcagcttccccatatctgttccctgtatgattcccttaagcatcaaaactatggacagtaaaaaacaagcgcccaaaccgcctgccaatagcgccaggtttttcattgcccccagataaatacccgataccaggaagaaccatccatcgcctttccccacagcctcttttgtcatccgggaaaggagaagcaatcctccccctaccgccattgccaggacagtatccataagccgccccatcgccaaaccaaatagctgtaggcgtcctcccccctgataggtgacggctgtatccagtacaatatacagaacgcgtaaaacagcgcctccggttccggacatcgcaatcagactaattttaattttgcggtttctcatgtcctgccatgctccggccaccagtgtcagcaagaaaccgcagcgcagcattactcctgccacttcatgtcctgccgcaagctgttccatccaatcaccacccagtatccccaaccaaacgcacccccggccttatactatttttctgtgcagccatattttttctctgcaactatattattttcttctgcagccatattattttcctctgcagtacgaacactcccccaaatattccacctgcggcaatggtactgcctgaacatacgcaataatggaccggcagctcttagacatatgatagcttgtaccatagggcatgacgtataccgtaccgctgcttcctgagccgcaggtcctgcagggcgaataccttcctccggactcattccgcagctcccccacacccctcacatccactgcctttaaattattataaagatagtggcaggtccttaagcggtggtagcgggtggaattcttaccaatatataccgtctcatcctcctcttcaccaccatttccgtctccacctccaaaacgtccgccatccgacccattccacattctgcggctgcacacctgcttcacgggaatactgttgattcccaatacggaaaagggaagccgcatcctgtaattcatcactatatggaccatctcgtccgttcctatatccgttcctgcaaacgatacagcctctatccactccctgttaacgcttcccagtatcctggcagaagcataagctgcagccaggacagaggaatccgtatcctcccacctccccacatccacttccgtcctgccctctcccgcggtacggaaacagtattccacataggcatactggctcagttcctctcccacggactccatcacagcctgaatctgcctctgacggtccagcatcttcatgggcatgatgaggcagaagcacaaaaacaggaaaagggacagactgagggccgcctctactgaaaggcttccctgcatctggcaggagctccatgataatgcccttttttcatggagcaggcgacagcttctacgtacttggagaggtgcggttgtatttttatctgctgttttattatttgttgttttattatttattgttttgctatctggaccatacgattttaattttatattctgcaccagaaaaaaggacatcatcatgaacctcctttccctattcctgataaaccggtacttgtcatttccatcggcttttacgggtctttataggcttccaggtaacttcccgctactgccatttgcgtgtcatacgtgtacccaccttcctttccctgacttttccacaatccattagaaaaaaatacatgttttccactgaccaatgcttccacatccactgtgcaggcacagttttccatagaaaattccggctgtttacctgctgtcacaagctgcatcacatccatcatccggtaaaccaaatccgtatcataactgccgaatataagtatccgcagatagcctttgtaatcaatgcctttcccatttccgccttcttccctatcaatcaggctcccctctttccccatctccaacagtccggccaaatccagtttccagtcagatgccgtcttaaaaaccggtacccttttcccctccagcaggtgccttacatccagcagcgcctctgcaagggcccataccgccatgataaagaacgccaccactgatacaagaggcagtatccctgttccccccactatggtcagggccaggctccgcgcctcctggcgcttgccggaatctgaaaggatatgcaccaggttcagtccctccctgagagcagtcaggcgagcggccacattgctcagattatccctgtctctgtcctttccatgaatgatatactccagctggtaaaattcccctttctgcatctcctgttcaaacccctgaaaaaaacggatgtcatattcccctatcaccagacgctgcaccagcgtactgaccccggttaaaaagccggtgcttttaaaaccatccccctgacccttttccttcccgcctgcgccttcagccttcctttgtgcagacggcgtgccggaaagcctgaggactgtccctgaaacaacggttccttccggcaataccagctccagcattccctttcccgccatgttgcccacctgttccagaaagccttccttttccttatcccggactccaaattccactcccagcgagagcatgccgtaccgggaccagtgttcccttaccggcatccacagtgccgcctcatctaattcgtcgtccttatcctccggctcccagctgctgatatactccattacctcctccgccatgtcaattacattcccaacccactgaatccggtcctggctcagatttgtcagcgcttcaacctctattcggcgctgtccgtcccgggcagcatatgactcatactggctgatttcatcctccagggcagcctttacatccccgcttagggcgccggcttcctcccaaaaccgttccctgcttccggccagtttttcatacagctcatcggctctttttccgtaagattttatctgacccggaagccgttccagctcccgtatcattttattggcctgggaaataaacccgcctccatccagctgttccaggcatgttttaccctgttcccaccgttccttctgggtcagaagtgttttgttgattgcctccagggccttttccagttttacagcttccctggaatgggcggaatacagttctgatatgcggttaacgctgtttccctccttccaggccgacaacagctctcctgcgccggcttcatccagctcgtcccaatccgcatcaatcagcccatacttcatgtaatccagtatttcctgctcaaaatacctcccatccccctgggtaaggcctgttatatctgttatcgtaatccggtccgccttcatgggataccagttatcggcttccatatagggccttagaaattccccgaactcctgctccagtgtctctgccctgtcatactcaagccccaatatccggtaatggtcccacagttccctgtgatactgggccataagggaatctgcggatgaatttactgccatccgcagatagcacctggctcctgctgtgcgggccgattccaccaccacacacagcagtgcacagacactgaacagtatcattgccagaaataccgtaatctcaccttttctgcacattaatacacctcttttgactggctgtttatctccttaaatatattctgaagcagggtggttatctgcttcttaaatataatgaccaggccaatgagcaccacgataaaatccagtacctgccccggaatgcttgaaaatacttgctttatctttcacatcactccgatgtgtaaattatttttctttttaatttagtaaatcgaaccgataccagctaatgttttataaggaatacccaaagtccagaaagaacctgtacgatatacagcgcttctttttttcctgttcttttgcccaggcattgacttttggacgggaatccattactcttaaaagagggccggatccggcccgcagaaaggaaattatcatacatggcaactttgggtaatccgaaaaataccattgaaatcatacagaaataccagttcgcattccagaagaaattcggtcagaattttcttattgatacccatgtgctggacaaaattataagcgccgcagggattacagaggctgactgtgtgctggaaatcggaccaggcatcggtaccatgacccagtatctggcagaacacgcaggaaaagtagtggcagttgagattgacaccaatcttcttcccatattggacgagaccttaaagggctattccaatgtgactgtcatcaacagtgatatcctgaagatagacatgaaccggctggtggatgagtataatgatggaaggccgattaaggtggtggccaacctgccctactacatcaccacgcccattatcatgggattgtttgagagcaatgtacccattgacaatattactgtcatggtgcagaaagaagtggcggaccggatgcaggtggggccaggctccaaggactatggcgccctgtccctggcggtgcagtattatgcaaagccttatatcgtggcaaatgtaccgcctaactgttttattccgcgtcccaatgtaggttctgcagttatccgcctgaccaggtatcaggaaccgccggtgcaggtggacgagccgggggtcatgttccgccttatacgggcttcatttaaccagcgcaggaagacacttcagaacggactgaataattcaccggaggttccgtatacaaaggagcagattgctgctgctattgagagcctgggagttcctgcctctgtcaggggggaagcactgacactggagcagtttgccggcctgtccaattattttacccggacagcgggaaacggggcctgcggttcataatgttatgccaggagcacaaaaacgggggtctgctgtgtatttcaggcggataaagggaataatcctggaaggacaattatctgtatcatcagagaatttatatataaaacagaaaggaaggtaagtcgatgaacaagaaagtgggtaaaatcctgacagctgcggcagcaggagcagcagtgggtgtggcagtgaaaaagctgcaggacagccggaaggaaaaggaagatgagagggttgccgccattgaggaagcggtgatgaataaccgggattacggcgacaggaaggcgtatctggtgggcggcggcctggccaccatggcagcggcggcgtatctgattcgtgactgcaagtttcctgccaaccagataacggtttacgaaggtatgcacatacttgggggaagcaatgacggcattggtacgccggagcagggctttgtatgccgcgggggacgtatgctcaatgaggagacttatgagaacttctgggagctctttcgttccatcccatccctgcgccagcccggacacagtgtgacggaggagattctggagtttgaccatgcccatcccacctgcgctaaggcaagactggtggataaggacggcaacattttggatgtgaaatccatgggctttaaccaggctgaccgcatggcccttctgaagctgctgatgacagacgagaaaaagctggacaacctgaccattcaggactggttcaaggagacgccccatattttcgagactaatttctggtatatgtggcagactacttttgcgttccagaagtacagcagcctgtttgaattcagacggtatatgaaccgcatgatttttgagttcagccgtatcgagacactggagggagttaccaggacgccgttaaaccagtacgacagcgtgattcgccctctggagacctatctgagaaaggcaggggtcaatttccgtgagaactgtgaagtgacggatatagatttcacggacggacctggaattacggtgaaaaccctgtatctgaagaagaaagtggagagtacagaggactcaggtgaggatgcagacgggccggctgaggtttcttatgtgaccgaggaggtccagttaaacaagagtgatatctgcattatgaccaatgcgtgtatgacggacagcgctaccctgggaagcctttacaaaccagcacctgctcctgagaagaagccaatcagcggagaactctggaccaaggtggccgggaagaagccggggctggggaatccggagccattctttaccaagcctgaggagactaactggctcagctttaccgttacctgccggggcgatgatatcttaaagaccattgagaactttaccggcaatgtgcccggcagcggcgcccttatgacctttaaggattccagctggcttatgagcagcgtggttgcggcacagcctcattttgtgaaccagccggcagaccagactatattctggggatatggactgcacacagaagccattggcgattatgtaaagaagccaatgaaggattgtacgggacaggagctgttaaatgaatatctccatcatctgcatattccggaggacaggattgcagagctgatgaagacggttatcaatgtaattccatgctatatgccttatgtggatgcacagtttgaaccgcgcaagatgagcgacaggccgccggtgattccggcaggctccaccaacttcgcaatggtgagccagtttgtggagataccggaggacatggtatttaccgaggaatactcagtacgcgcggcacgcattgcggtgtacggccttatggatgtgaagaagaagatttgtccggtgacgccttacaacaggcagcctaagatacttctgaaggcacttaagaaatcttatctgtagcaggggatatactctgccgtatggtttttaatattgggccggcttttgccggcccggacttttggaatacatacaagcgcaatataggcaggataggagataaatttaatgatattcataggaggaatcagccagggccagaaaatactggattatgtgaagactgtcatatgtgaccggtgcggcggatacgggcgttaccaggtatttatgacctatatgtatttcagctttttctttattcccctgtttaaatggaataaaaagttctatgttaaaatgtcctgctgcgatgctgtttacgagctggacccggaggtgggaaaagcgctgcttcacgggcagcaggtggacataagaagttccgacctgaccctggtacaggaggggaaccgccggggctattatgacagcggggcttataagacctggagaaaatgcagcaattgcggatatgagacggaagaagagtttgaatactgtcctaaatgcggcaggaaactgtgatggagtgggatgtgcagccggaggcaaggtgcatatcccattcacggtttcctgccgtctgcattagagcgtgttggaaaattgcgttccgtcagatgggcgttgcggttggaggggcatatggctggccgtttaaaccatttaggtcctttggcagatttctgatggtatccgcatgtccgcaaatgaaatatgcggttttgtatatcacgggataatgaaccaggaataatataatttttgaaattcaatctggaaatagaccctccgggatagtataatagagttagcctttacggtgcatctgatatttggagaggtgttggatgctgcaatggatatcgtcattgcataagagaaaggatgaggaaatgacagaaaatcagaaaatggatttgattcttcagaagttagggggaatcgagggcggtcttgtctcggtaggtgaggatgtgcagtcgctgcagggggatatgcaggtgctgaaaggagacgtgcaggtactcaaaggagatgtgcaggaactgaaaggtgacgtgcaggtactcaaagaagatgtgcaggtgctgaaaggtgacgtgcaggtactcaaaggagacgtgcaggaactgaaagaggacgtgcaggaactgaaagaggacgtgcaggaactgaaagaagacgtgcaggtactgaaagaaagggttacaaacatagagattacattagaaaatgagacgaacaggaacatccagctgattgcagagggacatttgaacctggaccgaaagctggatgaggctttaaaggaattgcatcctaatatgatgtaccatttaaaggtaaaccaccttgatggagaagtcacgaagatgaagcgcattctgaatatggcataaaactattttccggattttaattcaataatccaaagtaatcaagaggattttgcaaggcagacaacagctgcgttgcagaatcctttttgtattttcagcattcaatataagccgaatccattattccatatatgaacaaccagtaagatttattggttttacctccattttacgcgaacctgcttttggattttacctggataatttagaatctataggtagatttgcaggagagaaagggacggacgagggaggcagcccgaatcctggaaataggacttaattgatgcggacggatgggataaaacacagattgaacctaacattgctgcgtattatactgtaggtgatacattatattccatgccctttaactcttccacgcccctcctttactacaacaaggatatgtttgaaaaggcgggcatcatgcaggcgccctgctcagtgtattccctgaggccaggcaggtggttgagacggagatagagaacatgctcaacaatggagtaagcccggaggagactgcttccaagatggcgcagcagattaataaggcaattgaggaatataacctgctcaatgaatgataattatggattggagggtatactgagtatgaagacacaggtttgggcccacagaggcgcttcggcttatgcgccggaaaatacgctggaggcattccggctggcggcggaaatgggggctgacggcgtggagctggatgtacagttaagcagggataaagagctggtagtggcccatgatgagaccatagacagggtgagcagcggcacggggtatataaaggattataccctggcccagcttaaggggttttcttttaacagactgtttccggcatttaaagatgcccggattcccacgcttaaggaagtctatgaactgttaaagcccacagggctgaccgtgaatgtggagcttaaaaccggcatcatactctaccctgagatagagaaaaaggtactggcgctcactgcgttcatggggatggaggacagggtgatttattcatccttctgccatcccagcctggtaaaaattaaggagttggacggtaacagcaggacgggcctcctatactcggacggctggattgacgccgcgtcctatggacgtcatacggttggggcggacgccctgcatccggccctgtatcacctgcaggatttatcacttataccggatgccagaaggcaggggctggcagtgaatgtatggacggtgaatgaagagcagcatatggaaatgctggtgcagcagggagtggatgccatcattaccaaccggccggacctgtgcagaagtgtggttgacaggtatacgcagctatgacagaatatttgacagaaggcaggaatatatgattaaactggttgcacttgatatggatggcacccttctgcgccctgacgggcatatttcagagaggaatgtgcgtgcactgaaagggcttataagtacgggagccgagtttttgatttgtacgggacgcagttatatagatgcactggaaccccttaaggaggccggactcagggcgcctgtggtgtgcatgaatggagctgctgtgtatgattggaacggaaggcttatggatgaaatacggctttctgaggaacaggtcagaggaattctggaatgctgccaaaaggaggacatcatctttgatttcatgacggacaaaggcagttacaccacggcagatgaggcgcagttccgggcatgctttgagaggaacgtactgcttcccatggcggagtttacctatgagggagtgcgggaccggttttcttttgcggaggaaaagcagctttttgaaatgggactggcattttataaaatatcggtcatccatgagtcccggaaggtcctgggcagaatcaaggagaagctgtcaggtataccggacctggcggttgcgtcctcctttgccaccaatctggagctgacccacagctgtgcccagaagggcagggccctggcattttatgcgtcggccaggggtgtgggaccggacgaaatcatggccgtaggagacagtgagaatgattattccatgctgtccatggatataaaatatacggttgcaatgggaaatgccatggagagcatcaaacgtattgccaaatgccagacccgttccaatattcaggatggggtagcctatgccatagagacactggtgcttaccagggaggccagggcatactaagcgatttacaggttcagtaaagaaaatagttcacaggtaataagtatagagtccgcaggttctgcccataacgtccgcaggcgcagaacccggccggaaaagtccggccccaggctcttttttaattgcatttggcaggtaatcatgatattatgggtatacttcagcggaggttcctccgcaaaaggtcttagtgcttgcccggcagttcgccggaattttcagcggtgttatggtgcaatatcttttttgggatgtggggacagggggaatgtctattgtatgtgtgacagaagttcatgctgttgtcattttagagagggatgattacaattatttcctgcccggtctgatagcggtgtgtgatgggaacaaaataaaaaagaacggataccacggcgccccggacctggtggcggaggttgtgtcaataagcagcaggagcctggattatatcaggaaaccggtgaaatatgagcaggctggggtcagggagtactggattgtggacccgctgagaaatgtggttatggtttatgattttgaggccgttggtgggggggggggtaaattcatttgcactgcctctctcccgccagtcatgtctgttatcatccggctgatatatgcttcgtctatatgttggttccggtctgcccagattcaaaaccggttcaatcattcattaccgattgacaaataaatattccggtgctatgctagatgacaacagggagcttgtgaagcaggctgagaggaagtaatcaaacttcgacctatcgcacctgatttgggtaatgccaacgtagggaaatatgagacatgtatgtgtattgaatgcataatttaagtccatatcctgcgcggtatgggctttttttgcggccttttgcgcagcttggccttattatgaagattcactgtgcaggtgatacgccgcttatacggtcaatatgctgctgtgcaggcagaagaccgctgtacagaaaatatgcctcttcaccaggaagataggcgggctccgagtaaaaacatggaggtatgactatgaaagtaaacattaagaaactggcggtaagcgccatgctgacagcggtggccgtatccttatccggcttttccattccaataggggcatccaaatgtttcccgattcagcatcttgccaatgtattggccggcgtattccttgggccgtggtacggtgtgggtatggcgttctgcacatcctttatcagaaatctgctgggaacaggcagtctgctggcgtttccgggcagtatggcaggcgcatttttaggaggatatctgtaccagcgtttcggcaggctcacactggcttattttggggaagtgtttggcaccggcatactgggaggaatcctctgttatccggtggcaacactggtcatggggaaggaagcagctgtttttgcctatgtaatcccattccttatgagtaccatgtgcggtacggtcattgccgcgtttctgattggggtgctgtataaatccggggcatttcagtacatgaagcgtatgctgaatctggatgtacagcccggcaaagccgtgggaagataacataaaaggataaagtgatgatgcagagacaatggatgaaggacttgagggaacgctctcccagggtccactgtataacaaattacgttacagcgggagatgtggcaaacctggtcctggcagcaggcggctcccctattatggctcaggggctccatgaggtggaggatgttaccgccatctgcagcagccttgtcctgaacctgggaactctggatgagaagaccataccagccatggcggcggcgggaaggaaggctgctgccatgggacaccccattattctggacccggtaggcgtcactgcgtcgcggttccgcagacaggctgccattgatatcatccgccaggccccgccatctgtcatccggggaaatgaggcggaaatacgggccctgaacctggagctgagcggtcatgaggcgggcaatacctgcggcgtggattcagagaaccaaggcacggtccggagccgtatggaaattgcctgttccctgagggaccttaccggagcaattgtggtgatgaccggaaaagaggatgtggctgcaggaacagaaaaagagtacattgtcagaaacggtcatccctggatgaccaggattacaggcagcggctgtatgctggacgggcttgtgggggcattctgcgggctgcatggagaacagggacaggcaggcttgttggaggaatctgtggtcatggcactctgcgctcacggactctgcggtgaactggcggccggggagaccatggagcagggaggcgggactggtatgttccgcatgcacctgatggataaaatgagccttctggatgacgagacattggaaagaggtaaaaaaattgaaattcgataggaaacatcttttaatttatgcagtaaccgataaatcctggaccggaaaatactccctggcggaacaggtgagggaggcattagagggcggtgcaaccatggtccagttcagggaaaaggaactggacaaaggcaattttgaggaagtgctggaaactgcctgcgccatccgcaaaattaccgcagaatataacgtgcctcttatgattgatgacaatctggagctggcactggcctgtcatgcagacggactccatgtgggacaggaagatatggaggcatctgaggccagaaggcttctgggacctgaccgtatactgggtgttacggcaaagacagtggaacaggccagaaaagcacaggcagcaggcgcggattatctgggaagcggggccatattcggaaccaatacaaaagcagatgcccgccccatgactatggagaccttaaatgcaatctgcgacagtgtggatattcctgtggtggctatcgggggaatctgcctggataacataggccggctggccggcagccatgccgcaggagcagccattgtgtcaggtatatttgggtcgccccatatacgggaaaccacggaaaagctggttaaggcaatgggggaaatagtcggattgtcctcaccggacaagagtaagaaaatggaaaatatttaaaaactttgaaaaaaaccattgacatttggaaatgagctgattataataagctcaacattcaacgaaacatataaaaccgttgagtaggagtaagtaagattgtaattccaggcgcagagagcttccggccggtgtaagggagcattggattagagtctgaatggacctgcgagggcagctggaaaccagaggcatagagatagggctgatgggagtatgggctgacgggtatcccaccgttaccagggagaacgcatgatggtgcgttgcagagcgggcgtattttatttctttgttcgatgacacagcatcaggttaaatttaacttgatgctttttaatttcccataccacaggatggcagggaatgcaggtcacggataagcgccaaccagggtggtaccgcagaagccggaagaagcttttgtccctgctgattacagatgtagtcggcagggataagggcttctttttttattgaatgtgatgcccggacccggaactattgagaggttgaaaataaacagccagcatgaaggaaaggagttaacgtaaatgataatcccagcttgtgatgaaatcttaagcctgtcaggagaatatgatatcatccccatatgccgtgaggtttacgcggatgtggtgacgcccataaccctgctcagacgtatagcagaacggagcagccgcttttatcttctggaaagcatagagggcggcgaaaagtggggacgctactcctttcttggatataatccggtgatgcgtgttacctgccgctgcggtaaggtgaagattgagagcagtatcagccggttcccgtcaggggaaatacagaccgcccgtcccatggatgtgcttcgcgggatattggcgcagtacagggcgcccaggctgaaaggacagccgccctttaccggcggatttgtagggtattttgcatatgccatgattgagtatgcagagccaaccctccatatcagcagaggccaggccaatgattttgacctgatgctctttgacaaggttattgcctatgaccacctgaaacagaagatacagattgtggttaacatgaagaccggcaggacagaaaacgcgggaataaaggaccgggaacacggtgagggccggcagcactgtgaaggacagaactacggtggaggccggggaaatgggaacaaatccggcagcctggagtatctgatgaaggaatacggaagagcctgtgaggaaatacaggaaatggcctctcttatcaatgacacggcgcctcttaaacggctgtcctcaccggaaaaaccatccttttcctgcagcgtttccaaagaagcgttctgcagcacggtggaaaagacaaaggagtttattttggacggggatatctttcaggcagttatatccagacagtttaccagctcctatgagggcagcctgctgaatgcctaccgggttctcagaaccacgaacccatccccttacatggtttacatgaacatagaccaggatgaaatcatcagtacctccccggagaccctggtacgccttgaaaacgggcgtctcaccacgttcccggtagctggttccaggcccaggggtgcaacggatgaggaggacaaaaggctggaggaagagcttctggcagatgaaaaggagctttccgagcacaatatgctggtggatttgggacggaatgatattggacgcattgcagagttcgggtccgtggaggtgacggagtacaagatgatacacaggtattccaaaatcatgcatatctgttcccaggtggaaggaaatataaaacccggactggacggctgttcggcggtggaggccctgcttccggcaggcacactttcgggtgctcccaagatacgggcatgtgagattatagaaaaattggagtctgttccccgggggatatacggcggggctctgggatacctggattttacaggaaacctggatacatgcatcgccatacggatggcagtaaaacaggcaggaaaggtcacggttcaggcaggaggcggaattgtggcggacagtgtgccggagctggaatatgaggaatcggaaaacaaagcaaaggccgtcattcaggccatccttcgggcaggggaggtggatgacagatgattgtattgattgataattatgacagcttttcctataacctggtacagatgattggaagcattgagccggatatacaggtggtccgcaatgaccaggttacggtgaaagatatagagaacatgaaaccaagccacctgattctgtcgcccggaccaggatatccgcgggatgcaggcattctggaggaggcagtcataaagctgaagggaaaaatgccgattctgggcgtgtgcctgggacatcagggaatatgcgaggcattcggcggaaccattgcccatgcaaagaagctgatgcacggcaaacagagcaatatccggctggactgtcatataaaggaagataacactccgggcaaggcagatgcatccggaaggacaggatacggatgccggctgtttgagggactgccgtccgttataccggcagccaggtaccattccctgtccgcggttttggatagcctgccggaggagctggaagtggtggccagggattgcatggagggggaggtcatggcggtgcagcacagggattatcctgtatatgggctgcagttccaccccgaatccatattgacgccggatggaaggaagatactggagaattttttgaatatcagagcaatgtaacggaatgtggcctgtgaaaaccagaacagagcaggaatataatatcagggtttaagtaaaaaggagaatgactatgatacaaaaagcaattcaccaattggtagaaaataaaaatctggattttgatacaacaaaggaagtcatggacgaaatcatgagcggaaacgccacccaggcacagatatcctcgttcctcacagcactgaggatgaagggtgaaaccattgatgagattacggcctgcgcaactgttatgcgggataaggcggtaaagctgtcgcctccctttgcggtcatggacatagtgggaacaggcggggacgaggtgggaacctttaatatttccaccaccagcgcatttgtggcggcggccggaggcatacgggtggcaaagcacggcaaccgcagcgtatccagcaagagcggggctgcagacgtactggagcggctgggagcagagctgtcgctgacggcggaacaggcagagactgtcctggaggacaccggtatgtgcttcctgtttgcgccggcgtaccattcttccatgaaatatgcggcccctgtgaggaaggaaatcggaatcagaagcatttttaacatcctgggccccctgtccaatccggcaggagcatccatgcagctcttaggcgtgtacagccgtgatttggtggaaccgctggcgcaggtgctggccaacctgggagttaccaggggaatggtggtatgcgggggagacggactggatgaggcaacgctgaccggtcccacccacgtatgtgaaatccgttacggaaaacttacggcctatgatatgacacctgaggaactgggcttaaccgtatgcagcctggatgaacttataggaggcacgcctgaggaaaatgcggagataacaaagaacattttatccggcagcctgaaaggaccaaagagagacgtggtggttctgaatgcggccatcagcttatatctgggaattgatgactgcacagtgaaggactgtgtgaaaaaggcccgggacatcattgattccggagcagccatggccaagatggaggagttcatccgggccacaaagaaagcagcgggagaggtaaaagcatcatgatactggatacgatagccctgtccgccaggaaacgggtggagcagaaaaaacaggtaaaaccactggaagaaatgatgaaggcagcctatgagtgcagggagagggagggcattaaccgggaggatggagggaatgaaccccttgcttttaaagcagccctgtcaaaaccaggcatttccttcatttgcgaggtcaagagggcgtcgccttcaaagggactgattgctccggatttcccttatgtggaaatagccaggcagtaccaggaggctggtgcggatgcggtatccgtgttgacggagccggagttctttttaggggctgaccgttatctggaagaaatccgcagggagacagacctgccgctgctgcggaaagattttactgtggatgagtaccagatttatgaggcaaaggtgctgggcgcatccgctgttctgctgatttgctcccttttggacatgaagcggctgaaacggtatatgggcatttgcggcagtctggggctaagttcactggtggaagcccataccgacggggaggtggccatggcggcggaggcaggggccggtatgattggaatcaataaccgaaacctggggacctttgaggtggatttcacaaacgcactcaggctcaggagactggtggaccgcggcaccatatttgtggcggagagcggaatcagaacgcctgaggatatagagcttctggcagagaaccaggtggatgcggttcttgtgggagaaaccctgatgcgggcagcagacaaaaagagtgccctgcgggaacttaagtcacggattgggtagagacatacatgtgcagggaccgacatgtgcaggtacaaagatgtgcggcacagatataggaaataatgcagggggatggattatgaaaacatgcaggcttaagatttgcggtctcagccggtttggagatatcctggcggccaatgagattcagccggattatatcggctttgtatttgccgagagcagccgcagggttacgcctgataaggcagcccagttaagacaggttctggataagagaatccgggccgtgggcgtatttgtcaatgcatccatggaggaaatactggagctcgccgggaaccaggggaccggcagggtgattgatttgatacagctccatggagacgaggatgaggcttacatcagacagctgaagcagcacaccgtactgccggttatcaaggcaatacgggtcaggaacagggaacagattttaaaagcccaggagctgccctgtgattaccttcttctggacacgtatgcaaagggtaagtacgggggcagcggcacccagtttgactgggatatgattcccgggcttacaaagccttatttcctggcaggaggcatacatctgggcaatataaggcaggcagcggcccacggaccctactgcattgatgtcagcagcgcggtggaaacagggggcaggaaggaccggagaaagatggaggagctggcccaggtcctgcgggggcagacgcagagcccggactgtccgcttaatagctgcatttaacatgactgtataaagaaattgtatcagaaaaggagacacagcaatgtcaagaggaagatttggaatccatggcggccagtttataccggaaacactgatgagcgctgtcgcggaactggaagaggcatatgagtactataaaaaggagccgcagttcatggccgagttaaagtatctgctggaggaatacaccggccgtccttcgcgcctctattatgcggagaagatgacaaaggacctgggcggagcaaggatttatctcaaaagggaggacttaaaccacacaggttcccacaaaatcaacaatgcgctggggcaggttcttctggcaaagaaaatgggaaagaccagggtcattgcagagacaggggccggacagcacggcgtggcaacagccacggcagcagcccttttgggactggaatgcgaggtctatatgggaaaggaggatacggaccgccaggcgctcaatgtataccgcatggagctgttgggggcaaaggtacacccggtgaccagcgggacgcagacattaaaggatgctgtcaatgagacactcagggagtggaccaaccgcattgcggatacacattatgttattggctctgtcatgggcccccacccatttcccatgatggtaagggatttccagagcgtaatcagcagggaaatcaaggaacagcttatggaaaaggagggaaagcttccggatatggttattgcctgtgtgggaggcggaagcaatgcaatgggagctttctatgaattcatccatgaaaaggacgtgaagctggtaggatgtgaggcggcaggactgggcgtggagactgagcagactgcagccaccatagccacgggcagggtcggcatttttcatggcatgaaatcttatttctgtcaggacgaatacggacagattgcaccggtgtactccatatccgccgggctggattatccgggcattggaccggagcacgcgcagctccatgacagcggcagggcccagtatgtgcctgtgacggatgatgaggcagtggactcatttgaatatctgtcgcgtatggaaggaatcatcccggcagtggagagcgctcatgcagtggcctatgccaggaaggtggcaggctcaatggataaggaccagattattgttatcaatctttccggcaggggagataaggacgtggctgcaattgccagatataagggggtagagctctatgaataggatacagcaggtttttgagaataaaaaggcattcatacctttcataacagcaggcgacccggacctgtcagtgacagaggcgcttgtgcctgccatggcagaggccggggcggatttgattgagctgggaatacccttttccgacccggtggcagagggaatcgtcattcaggaggcagaccttcgggcactggcttcaggaaccaccacggacaagatatttgatacagtgcgccggattcgccaaaagacagatgtgccgctggcgttcatgacctatatcaacccggtgtttgcatatggcgtggataagtttatgaaaaatgcctctgattgtggaatagacgccctgattgtgccggatatgccctttgaagaacgggaggaactgctgccggcttgtaaaaagtatgatatgaccctgatttatctggtggcgcccacctccagggagcgggcccaggccattgccagggaatcccatgggtttgtatactgcgtgtcatcccttggagttaccggtgtccgaagcgagattaccaccaacattaaggaaatggtggacactgtaaagcagggaaaaaatgtaccctgtgccattggattcggcatctctaccccggagcaggccggcaaaatggcttcccaggcagacggagtcattgtcggaagcgccattgttaagctggtggccaggtacggtgtaaactgtgtggaacctgtctgcaattatgtgaagcagatgaaggccgcagtgggggtatagatgggcaggagatgaaagggggaggaaaggggctgggcggaagattctgaagagcggatatactgcaaggcggatatacctaagactccctttccttcgggccttataacagccggcatttaccacctgtgtacagatttaaatgaagttcagccttctggcttccgtatgaacagcctttctgattaggctgttttttccatgaaatgaagggatgcttaaattcagggggaattttgtgctataatcggataaagcacacaactgccggaagggagttcgtattattgcaactttcggcgtaagccatcatattgaagatgacaggattgaggcagcggcagagccctgtcccaaccgctggacccaccatgtaattgccaggagtgtggccgagatagatgacaagctgatggggcggattaggaaggcttatgagtttgcgttggttaaataggatacagtgtaattatggaaaattaaagtatggaagtgatatgcggtttgtccggcaaggacagccgcatatctgcgtttttgccgaaagtgagggggtgtatgtcccaaagaaaacaaaagttttcaaaagataattaatttaactgtaaataataaaaatctataatgaatataccagaaaacagtcagaaacatagaaggaggaaagatatgagaagaaaaggcctatgtatggcagcgttattattggcagcagcaatgttatgctcagggtgttcaacagatgcgtctccatccggcaatacgacggcagggcagcagtccagctcatcccagactgaagcgcctgtaaaggaggaaacggttgccggcagcgaaaaagaaacgtcttcccaggacggcggaggaaaagcagtgaatgcgtctgattatctgattggatattcacagctggcaaatacaggcacataccggattgccgagactaacagcatgaaggatgaggcggagaagcgggggtttaagctgattgtcacggatgcccaggataatacggctaaacaggtatctgatgtggaagacctgattgcccagaacattgacttgctcatactgtctcccagggagtttgagggattagagacagcattgcagacagccaaagagaattctgtcccggtaatactggtagacaggcttgccaagggcgagccaggagtggattatgtaacctatattgccacggattttgtatgggaaggacaggcagcaggcgaatggcttaaggaaaagaccgggggaacctgcaatatcattgagcttacaggaacagtggggtcttcttctgcccaggacagggctacagggttcgcaggtgtggtgaatcagaatgagggaatgaagattatcgcatcacagacaggaaattttgaacggtctgaaggacagaaggttatggagaatctgctgcaggcccatggcggtgaggtggatgcagtattctgccacaatgaccagatggctctgggggctgtgcaggccattaaggcagcgggctataagccaaatgaggatattctggtaataggaatagacggggaaatggattcatttaaatctgtcatagccggtgagatgtcggcaactgttgtcagcagtcccatgtatgggcctattacctttgacacggtagaaaaaatcctggcaggtcaggaggttccggagcagaccatcatggaaggcgtggtggtggatgcgggaaatgcacaggaaaatatggacctggcatattaagcagagaggtatgggtgaaggaacggccatggagaatcggtatttattagagatgcagaacatatccaaaggcttcccgggtgtacaggcaatcaaacaggtggattttaaggtcggatatggagaagtacatggactgatgggggaaaatggagcaggaaaatccaccttgatgaagattctgaatggtctctacagcagtgacagcggaagggtcctgtttgatgggaagacggttcatccccagtcttccctggaggcccagaaactaggtatcagtactatctatcaggagttgaatcttataccggaactgagtatatgtgaaaatatatatattggcagagagcctatgggaaagtggggaatagactggaaggcgatggaaagaaatgccagggaacttctgacaggtatcggcctggattatgatgtaaagcagcccctcagcatacagggagctgctgtggcacagatggtggcaattgccagggcattggccattcagtctaagctggtagtgatggatgaacctacatcctccctggataaccaggaggttaagattctgtttcaggtaatccggagacttaagagccagggagtatccattattttcatatcacatcgtttaaatgaggtctatgaaatatgcgacagggttacgattttgaaggacggtgtatgtgaaggtgagtatggtatcaatgagctggatgagatatcccttgtctctaaaatgattggacagaaggtggaaaacagtgaatcgcgtttacaggataataattatcactgcgacagccagccaatctgcgagatggaaaatattaccaatagcaagctgaaagggatatcgtttaaaatgaacccgggagaagtattgggatttgccggattgcttggttccggaaggacagaactcattaaggtactgttcggggaggatacggattataggggaaccattgtgatagacaaaagaaaaatcagatttaaaatgccatcagatgccatccggcagggaatggcgctctgcccggaggaccgcagaaccgagggaatcataccaaacctgtcggtacgcgagaatatatccattgtccttctcccgaagctgaccaggatgggaattatatcaagaaaagcccaagagaaagtggcagcagagttcataaacaggctgggcatcaagacacctgacatggaacagaaagtcaggaacttaagcggcggaaaccagcagaaggtattgctggccagatggctgtgtacctctcccaggctggttatcatggatgagcccaccagaggaattgatgtgggcgcaaaggcggaaatagaaaaaattgtgcgtgacctggcaaagcagggaatgagcgttgtcatgatttcatcggaaatcagcgaggtggtaaggaacagcaaccgggtgatggtgttgagggatgggcgtaaattaggtgaacttactggcggggaaatcagccaggaagaaatcatgaagaggatagctgacaacaaagtattcagtatgtgaggataagaggcgtgatatgagtaaattattgaaaaaatacggagtatacctggccctctttgcaatggtagtgtttaatagtctggttaccaggaatttcttcagcctgaatacctgctggaacatcatgattcagagcacgaccgtaatgtttgtctcccttggaatgacagcggccattgcttcaggcggaattgacatttccattgggcccgttatggccttaagcgccattgtgtttgccagacttttagacgtttcggtaatcggtgcgtttataagcgcgttggcgctggctattttctgcggagcagtaaacgggttcatcattgccagattttccatacagccaatgattgttaccctgggaatgatgaacatggtccgggggtttgcggaactggttaatgatggaaggacatattccttttcccatccagttatatcaaatcttggattttataaggtttttggcttagtgccaatccaggccctgtttataataatggcagttggcgccatgtacatattgatgaagcggatgcgcttcggcgtttatgtcgaaaccataggagacaacccgaaggcagccaggctctcgggaatcaggatttcaggcatgatggtccttatttatatgctcagtggttttcttgccggtgcagccggattggtagaggccctgcgtatgtccgcggcagaccccattaattttggacttcagattgaagtggatgccattgcctctactgcaatcggtggtaccaatatggcaggggggaaagcaaacctggcaggaaccgtggccggtgtgttcattatgcagataataacagtaatggtgaatatgaacaatgtgccgtattcctattctctggtcatcaagacgctggttgtcatcattgcggtctgtgcccagaacggaaaatttacaagattggcaggatttaggaagaggacggaggtaaatacatgggcggttcaaaaaaatatatagtctggatacaggaaaagagcgcggtggttgtattcctgatgcttttcctcatatcagccctgcggtataaacagttctttacccccatcaatctggtaaatctattcaggcagtccagcataataggagtcatagctgtggggatgacatttgttatcataacagggtgcatcgatttgtcggtaggttccactgtagctgtgtgcggtattctggcagcacggatgtgctcggtgaatattggggctgccattctggttcctctgtgtgcgggagcactgattggaattataaacgggacctttgtaaccaaactggaagtaccgccctggattacatccctgtccatgatgatgtgcctcagagggatagcctacatcatgaccaatgaaagctcggtggatgtggaaaaggtttctccggcctttcagatgattggaaggggaaagatactggggctgccggttcccggaatcctgttccttctctttgtgctgattggggcctacagccttaagtataccagatttggacggagcgtatatgccacaggaggaaacagggaaggagccaggatgatgggaatccggattgacaggactatcatcctatcatatatgctgtgcggcatcggcgctgccatgtcaggtctgattctcgcctccaggctgggggctgcccagtctacggcgggagaactttatgagatgcaggttattgcagcagtggtccttggcggaacgcttctgaccggaggcataggccatatggcaggcacgttgtttggtgtgtttaccatgagcatgatagcaaatatttttaatatgcagggaaatatcagtacatggtggcagaatgtaatcatgggatttcttattctggtgattgttattatgcagtccggactggaacagataaaaacgaaaaagagtgaggaggaagctatatgttgaattacaatccatataccgttggatgtcaggccgggtggaggaagtatgagcacaaccctgttattggggaagacggggatttttgtttcgacaatcatgtattaaaagcaggagacaagctgagaatgtacttttcctggaggacacattacagtatagcatacacagaaagtgaggatggccttcattggggggaacgccatgtggtgttaagtcccagaccggagattccatgggaggaagatttaaacagaccagccattgattacagggatggaatgtttcgtatgtggtattccagccagacaaccggaggatttaatcagaaaaaatgggtggactcatatatggaggcatctaaggaggataaaggcgggtctgtcatagggtatgcctggagcagggatggaatcagttgggaaagactggaagagccggtactggtaccaaatcagacctgggaaaagcgttccttaatgtgccccactgttctgtgggaccaggagcggaaaatatataagctgtggtattgcggaggagggtggtttgagccggatgccattggctatgccgagagccaggatggaattgtgtgggaaaaatgcggagggaatccggtctttacgcctgataaaaagaatctttgggaacgggcccatgtggccggctgtcaggtgatagaaatggatggctggtattatatgttctatattggttatgaggacttgtttaaagccagaatctgtctggccaggtcaaaggacggtgtaagcggatgggaacgccatcccatgaaccccattatttcggccggactgccgggggcatgggattgtgaatccatttataagccattcctgtattatgataaggattatgacaggtggctgatgtacttcaatgccagaacaggaaccacagagcgcataggaatcgcaatacatgatggacgggacttctggaattgctgatggttatatggtgaactgcataaattttatgaaaggcagcaggtttaagagaacactccaggctaagtttggagcgttctctatacctgctttatgggattcatgaaaaaaatatacgctcatatgatgaattataaacttcacaccaggctgatgatatacttttcaactatggtaattgtggccatgcttttggtggcgggtatatcctacattgcatcttaccggattgtggaggaactggcctattccttcagcaatcagtcggcgcagtctgtggcggataatctgaatgacatcttcaatgaagcggaaaacctgtcaggtcttgtggagaacaattcgattttccagagcatcctgaacgcagagatgccggaggatatcagagatagatatgcaacagagctgaaatatgattttgagttgtaccagctggcaggatatacaattaatgagttcggaggcttatatgtgctgggggataatggttttaactttaagtcccataatgtggcatttcaggaaacagattttaggaaggaagaatggtaccggcgcatccatgaagcggatggggtcgtgtggtttgggcctaaggtttattccaggacagttaaatccattgaccggtcctatgctgccatgggatgcccggtgataaataaggccaatggaaacagaatcggcgtggtattggtggaaatagaggctgattctattgaatatatcatccgggaattcggcaatatagaaaacggggtcattcaggtacttgatggggaaaatactattctgtttcaaaaaaatggtactggtaatgattccggtgaagcaaaaagccataaggacaggaacaggaaccattccgtattttattatacagagacaatggataatggatggactgtggaatcctatatccccaaggccattctgctgggaaggattattaacctgggaatctggctcgggctggtgatatttttgatgatactgctggcggttaaggtcaccagcgtcatttccggtacagtgaccaatcctatcaataaattaattgaccttatggaacaggcggaacaaaaggaatttgctgttcagatgcatgtgaaatataaggacgagctggcggttctgggcaataagtttaacaatatgatggattttacaaggcatctgattgcggtcaataataaggaacaggaaaatctgagggaagcagaattaaagacacttcaaatgcagattaatccgcatttcctgtataatacccttgaaaccgtaatatggctgatacggtccaaagaaaatgaaaaggcaatcagcgtgattacatcactctccaaatttttccgtattgggttaagcaggggacggaatatcataatgctaagggaggaactggaacacgtcagggaatacgttaagattcaaaataccagatacagggataaaatcaatttttccatccatttaacagagaataccatgctggactgtcccatacctaagctgaccctgcagccattggtggagaacgctatttatcacggcatccaggaaaaaccggaaggcgggcatgttttgattgagattgcccgtgaagcacaagacagaatcaggataacagtcgctgatgatggcattggaatgacaccggctcagttggaacggcttcagaccgggttaaaggaaatgggggaagtgggtttcggtatgtataatacgaatcaaaggttatgtaattattttggggaagagtctgctttgaagattgagagccggtttggggaaggcaccagggtgtcatttagcatcaacgacagcaggagggagggaaaagtgtatgattaaggccattcttgtggatgatgaagatatcatcagggagggactgtcaaactttatagactggactgctttgggtctggaactggtgggacaggcatccaatgggagggaggctgtggagctggtaagaatgatggctccggaagtgattataacagatgtgaaaatgcctatgatgaatggaattgaacttctggccctggcaaaggaacaaaggccggactgcgtggttatcatgattagcagctatgaccagtttgaatatgcccagcagtcccttaatctgggcgcctttgcgtatctgctgaaacccattgatacggataagctgattcatctgttaaaggaagctgttttaaaaatacagaaggtcaggtcaggagagaagatattaaatacatacaggaatgtgctggaacagacccagaaaaatatattagataataaaattaagctgatggcacttggaggaagggtgaatgccctgaatgagactgaggcaaagtatctggaacagtttacaaaattctgtgtggcttcggtaaatgcagagagacctgaataccaagaagagtcctttatggaggaactggaacgtcacctggaagaatggaggaccggacacgcagatgcagcagacataaaacaattccagaaccagaaccggatgaccgtgttctgtgtcatgatgagaggggataaagagataagctttcgtaaactgctggctatctattcccggtattatacggaaaccgtactggggataagcgataccgttgattctgtcagggaactatcggctgcttaccgccaaagcctggaagctgtggaataccgtttttttacagacagaagtctgattcgctaccgcactgtccgggaggaaatacagccatcctttaaggatatgcctgactggaaccggaacctggaaatgtgtctgaaggatgggagagaaagtgaggttaatacatttacagatgaatttctgtcatatgtttaccggacgaaaccatccccggtaattatacgtaccatggtttcagctattctgctggagacaatccgtacgttgagaacagcgggaggtaaaccagaggatttgtttttgtcagtatcagacaccattgccgctgttttgaatgaaagcaatcctgaattcatgtccagaaaactcagggagctgttatggagcgtgtctgattatattgccaggctggaaaagctaagacctaactcagtggcgcagaaggccaggaaatatatagaagagaattatcagaaccctgatttgaggctggatgatgtggctggatatgtctatataaatgccagctatttcagctctgttttcagtaaggaaatgggaatatcctttggggattacctgaccaaggtgcgtattgaaaaagcaatggatttattgaaaaatacgcatatgaaggtatatgagattgctgaatgggtgggataccagaatccctcctggttcaatgtggcatttaaacggtatacgggacagaagccaggggattttagaaaataaataccacacgctgcataataataattctgatgggaaaagccggcccgggtgagccggctttttaggttggcagttttaattgctggttttgcggcagcggcataaaaacttgcaaatgttgtaaaaaaaccacagccacacagggagggggaataaaaccagcagtaatatggatgtaaataacaaaacaagataaaaattatcgcgtagtaaaagaaatatattcaattatatcagaaaattcaaaccaaaataaaaaaatcacagttaaaaacatatcaagaaacgcaaaaaaatcaggacaaaacagaaaaaaaggtacgatagaatatgatattatttctaatagacagagacaggaacacaaaaaaatatacaaattacataaaaatgggggatatatggagagtaagaaggtattagtggcaggttccattgtattggatattattcctgaagtatatattccgaaagggcagcccgtaccggaaatattcctgagcgagggcaaaaccacggaatgttcttatacccatatatatttgggcggggaagtagggaatacaggtctggggttaaagaagcttggatgtgatgtaaggctggtcagtaaaatcggagacgattccgtaggggaaatcgtcagggaaattttaaaccgctatgacgcggattatacgctgattgagatgatgggggaacagtcctcggccagcgttgccattgcccttccgggtaaggataaaatgacgcttcacagcaggggggcttcccagcttttcaaggcagcggatattacggacgaaatgctggaaggggtaaagctgttccactttggctatcctcccagtatgaagtacctggtggaacatgagggcgaggaactggaggatttgttaaagaatgtaaagtccaagggaatcactatttctctggatatgagccttccggatttaaagacatttctgggacatgtggactggagaccaattctgcagcggatactgccctatgttgacttatttttaccaagcctggaggaaagtatatttttcctgcacagggaggattacgttgaaatggtgcgtaaagcaggggcaaacgaccttctggattatattgatataagaggaatggctgagaaactggcggatgagcttctggaaatgggcggcaccgtggttatgctgaaatgcgggcatgaggggatgtatctgagaacagcagggaaagagaggtggggaaatatgggaaaggctgctccggccagcctgactgggtggtatgacaggaaaatctggcagaagcccgtaaaggtcaaacggattttgtccaggaccggagcaggggatattgcaattgcaggatttttatcctcgttcctgcatgaggataatgcaaagacagctttggggatagctgcatgggccgcgtccatctgtattcagtcatatgataccataagcggtctgtgcccgttaaacgagttgtaaacaaaagagaaggagtaggaggtatttcataatgaaaaaaggtttggcaaaaatgacagcattgggattatgcgcatcaatggtcctttccatggcagggtgttccggcgggggaggttccgcttccacggaaaaggcggctgagaagacagccggggcagcgacggagaaggcggtgcaggacggaacggagggaagccaggaacccattgaactgacatactggtactgggaggacgaacagggtaccattgagaacatgcttaaggacaagtgggaggcctatgcaggggaccgcattaaggttaactttgaatccgtaccctcttccagcttccatgataaacttataactgccatcagtaccggtacagggccggatgtgtttatctgtaagcccatgtgggccccggagctgtacggaatgggcggcctgatgaatatggaagatgtgtttgagggctgggagtacgcagatgaggtggacgatttcatgctggaacagatgagggcggggctggataagctgtatctgtatccgcgtaccaccattgtgatgtatctgtattgccgtaagtccatgtttgagaaggcgggaatcgattatccgaagaccgtggatgagttctttgatgcctgtgaaaagctgaccgtggatacggacggggacggcaagacagaccagtacggatttggtatgcgcggcggcaacggcggccattacatgtggtcatcctttgtattcagcgcattgaaggataaggattactatgatggggaggggaaggcgtccctggcagacgagaagctggctgagatgaaccagaagtacattgacctgtatcagaacggttatgtgccgccctcagccattacggacggattcagtgaggtccttactaattttaagtcaggcgtcacagccatgctgtatcatcacatagcttccataacaaccattaaagaaacctttggcgatgattttgaggtgatacctgtccccacaggagagagcgggcaggcattcggctgtcaggaaatgacgggatgggccatcaatcctaattccaagaacctggaggcagcggaggagtttgtgaaatgggcgtcttcacctgagattcatgatgtgcggtgtgagaagctgcagcaggtgccgttcatgtcttccgtacaggcattggacaagtacaaaaatgaccaggcatataaggtatccatggacaacatgctttccgcccatacattgccggtaggacctgaaatcacaacttatacagaggaaatatgggcacagacattccagagagccctgatgggagaactgagcagcatggagatgctggaacagctggacaagtgcctgaacggggaaatgtaggactaaaaccatgagagggtgagcgtatgaatcggggaaaagcagccggaaaaaggcgcaggaaatcagacatatatgttcccattatattgttaatgccggcatttctgctggtggtgggagtcataatttatccaatctgctatgcagtgggactcagtttccagtattataaattgacggattatgtaaaccgccagtttatcggtttagaaaactacatatctgtctggaggaatgagacatttctggcttccctgggaaatacggtaaagtgggtgggaatcactgttgcctgtcagttcctgtttggactggtgctggccatgattctgaacgtcccattcaagggaaggggcatcatccgttccattacgctgatgccctgggtcaccccgggcgttgtaattgcgcttatgtgggtgtggatttataacggcaattttggcgtcctgaacaaatgtctgacgtccttgggcatcatcagcaaaaatgtcccgtggctgggctcatcccggacagcgctgtacagccagattgtaaccatgatatggcagggaattcctttctttgccatcatggtactggcagcgctgcagaccatatccgtggacctgtatgaggcagcggatataagcggggccaattcctggcagaaatttgtgtatatcacgttgccggagctgatgcccacaatcataactacctgcatgctgagaatcatatgggtctttaataatgtggaggtgctctatctgatgaccggaggaggaccgggccacagctccatgactgtatcccttgtagcctatatcaaggcgcagaaatccctggatttcggacaggggtcaaccatagcaatctacggcaccctgtttatgattctctttatgaccatatatttaaagctgacaaggcggggggatgaagatgaaaaggactaaacgaattcagaagcttgtaatgcttattccgcttattctgatagtgtgttttgtgatatttccttacatatggacattcctgacctccataaagcctacagatgaactgtataccaccaacataaaaatactgcccagggcaacgaccttccagaattacgtgacactttttacgggtacggatttcctggccagtatgttccacagcattgtgattgcagtcattacaagctgcatctccatgctggtgtcatccatggcatcctatgcctttgccaggtacaggttcagggggaagaacctggcgctcagcggtatcctgctgttatatatgtttccgtcggtcctttacctgactccgctgtttgtggtgtttaataagatgaagctcataggctctcctgttgcattggtggtttcatactgtacgtttaccatacccttcagcatatggcttctcacctcatatatgaagagcattcctctggagttagaggaggcgggcaagatagacggggccaatgtcccacagctattatattatgtggtaatgccgctgctgaagccagggcttattgctaccggcacctatgtgttcatcaattcctggaatgagtatttgtttgcagtcatgttcacgacttccaataacaggacgcttcctgtctcattggcatccctggtaggagagtatgacctgagatgggacatcatatcagcaggagcagtggcagccatgataccggtggttatcctgttcatgtttatacagaagaacctggtggcaggtctgactgccggttcggtaaaggggtaaaaatgaagaatcaagcagcatttttgatagataaacagagattagagattatggattgtgaaatgccgtccgtttccgatacggatgtgttggttgaagtggcccatgtgggaatctgcggaagcgatatgcacatatttgaggacccgtattatgcggtaaaagatataaagcttccggtagtgcttggccatgaatgcgccggacgcgtagtggaggtgggaaagaaggtagaaggaatcgtaccaggcgaccgtgttgcgctggagccaggcgtaccctgtcagacctgtgagttttgtatgagcggacggtataacctgtgtccggacgtacggtttctgggggccagaccatggctgaacggcgcattcagccgttacgtcagtcatcccgccagatggacattcaaactgcccgatgcaatggacacagtggaaggagctttgctggagccgcttgtggtgggaatgcattcagtaaaccgggccaatcccgggaccggacaggccgtgctgatactgggagcagggtgcatcgggcttatgaccctggaggcatgtctggccaggggaatcacaaatgtgaccatatcggatttatatgaaaaccggctgaatatggccggcaccataggcgccagacatacggtcaattcatcaaaagaggatattgtgacaaggaccgcgcagataaccggcaataaaggatatgacgtggtatttgagactgcgggaagccagagaacagccgcattgacagcggacctggtgaaacgagggggaaaaattgtaatggtcgggaatgtgttcggggaaactccattcaattttttcaaaacaaattcaaaggaggcggacatactgggagtattccgttaccggaacctgtatccggcagccatagagctttgcggcgaggggcaggcggaaccaaagaagatagtgaccaattattttgaatttgaaaccatgcaggcagccatggagtatgccattacaaaaaaacaggaagctgtcaaaacagtgattcggatgtagaaagacggggacaggaacatatgtatacagatgtgaagacaatactggatgacgcatccagaaatcattacggcgtattggctgcatccgccatcaacctggaattggcaagggggctgatagcggctgctgatgaactccaggcgccgttaatcattcttatgggtcagatgcagatgaccagacatgccagggcggatgtgatggtgcctctgataaagacgctggcagaggagaccaatgtcccggtggccctgattctggaccacggaagggactgggatgtgattacacatgcatataggaacggtttctcctctatcatgattgacgcttctgcttatgagatggaggagaatgtaaaaagaacgaaaagggtcatagagctgtgtcatccccagggagtggcggtggaagcagaactgggccatgtgggacaggctgccctgggagaccagacagatgattcctgctatacgcggcctgaggatgtaacggagtttctgagccggacccatgcagactgcctggccattgcctgtggtacggcccatggacagtacccaaagggcgttacccctgaaatacgttttgatatcatacgggctgtcaaggaagtgacggatgtgcccattgctcttcacggaggttccggttcaggggatgaaaatataaaaaaggcagtggaggcaggtataaacaaggtgaatgtctgcacggaaatatttaattatgtccgcgatgaaatcaggaagacactggaggagacgccggaaattgacctgttaagcctgatgtccctgaccgagcaggcggccagaaaaattggaaagcatttcattggcctgaccggctcccagggaagggcagctaatttccggagaaggtcaacctttcagtatggctttgcgcagacagagacggatgggggagaataagaggaaaaggccggaaagaaaatatacaggtataacgatgaaggaaaatgaacaagggtggaaccgataccagaggtttccacccttatttccgtttaaaatcctccgcctgtttgaacttagaatattgttttggactgagaccggtgtgctgtttgaagatacggctgaaatgggacaggtttttataaccgacaagaccgcatacagaatctacgggaagattttgtgatagaagttcctttgccctcatgatacggcagctgatgatatactggtttggtgaagtacctgtcacattcttaaaaagattgcacagataaaatttgttaatataaaaagtggaggacagcagctccagggaaagctcgtcgctcaggtgcgtatggatatggttgatgacggagtaaatcaggctgtaggacgaggttatggtatcggatgatatattatggtacttccggtacaggttatttataaaaatcaaaaattctcccagaaggaatttgactttcaggtcgtagccgtaatcctgtttggtggtatcatcattgcatgcaaccagccgttttagctgggccagacattcctctgcctgggaaatggtcagcggcaggatatatggatttgagaacggccttaagaaaaaacattccagcaaatccgtttccttggaggacagggattcaatgtattcgggtttaaaggaaagcgtataccgttcaaaacgttcgcgggtattcagggtaatcttatgcaaatccatattattgaataaaataatactgtttttgggaaccttccagtttttttcgcttacatgacagaccgtattgggcgtgagcataaatatgatgtcaaactgtttgtgggtatgatattcatgctgctccgggccgtaggtcactttgtatttgaacgaaaaatcctcggaaaaatggggggatatgggtgttttagcgggcataatcttgagcaggtcacctcccttgcaagttctcataattccaattattgtacataacataccaggatttatgcaactatttaattaaacatcaaaagaaatgcaaaaaacacagaaagaatagtaaaaatccattgtgagtaacgcataaaaggcgcatcatggaatttggaaaaacttttgaagaaaacaactgctttctgtcaatattatggtaatagaaagcaatggaaaactgttaatataagattaccgaagggatggcagggcgatggaacaggaaacaggagggaacatgatgcaggaacggcaatataaaattctgaagctgctgtacaggtcagatggattcgtgactgtagagtatctggcggcagagatgcagtgttcccttaagactatcaggaacgatttgaagcagctgggaagtttcctggaagaacacgggctgggaaaggttgtctctaagagtaacaaaggcgtctgtctcatgaaagagaaggactgggcagctgcaaagcaggcatggaacgatgagaaccagatggagctctacggcacggacaaccagttccagatactggagctgctgctgaagcagagaagcatacagaagatgaagctggaacagaggcttctcatcagcaggctggacgctgaaaaggccaccaatcaggcggccgcatggctggaggcccataggatagccgttacctgtaagagaggacaggggctgcagattgagtgcagcgagtacgattggcgcatggccatatgggtgctttttgcggatatatccaggaaacgccaggagtttggggaccagtcgctgaaaaaccagacagagaagtttttgtggggctttgatatgaccggggttacaggggccatcgcagggctggaacgggaattcgggatacactacagttttgacgggtaccagcagctttccttccttctctcattatgcgttatacgaatcaggaaaaaggaatttgcggagattccggctgcggattttgagtatggggctaaagaaaggcagggttcagaaagtcagggttcagaagggcagggctcagaacatcagcggcatatgcggacctgcatggcgtaccagggtgtggaatacgaccggaatatgggagaaatatgcatagaaagccttaagaaatattatagcatcagctttcctgagggcgagaagcagtttgtggtactggctttggggattgcagaaatacaggagtttacaggagaggcatccaggcggacctttatggaggcaaaccaaaacatctgccgggtgacggataaagtgatttccattaccggcaatatcctggggcagggtcttggcagggatgaatacctgtttgacagcctgctgctgtacatgaaatccaaaatcctgaagctggggtacaacataccggaggaaaatcccctgaaggaggttgtgaagtccaagtatcccaatatatacgcagccgcctggtcagccagccttgtcattgagtctgagctgggggtgagaatcggggaggacgaggtggcttacctggcattatatataggcggggccattgaacgcctgaatgtgggagtggaggtgtgtatcctgtgcaaccacggtatcggtatatccagaatcctcaaggaacagattgagcgctccatacagaacatacatgtggtagatgtgctgactaccagggatacactcaagattcagaagagccggtgtgattttctcatatcatctgttccggtgggaaatgtatttgcgggaaaggatgcggtacagattggtaatgtgctgcagccctgggacatacagcagattcagaataaaatgaaactggtccggaaaaagaagatgaggcggattgcggcgaaggcggaatactccgagtatcagctgtttcattcctccctgatataccattttccgggaaagacccataaaagggaaatcatatcctttctgtgcgccagactggcggaggcaggctatgtaacggaggattatgagcagaccgtactggaccgggaggaaaccacatccactgtgctggaccttggagttgccattccccatggagctgcttcctgcgtctgccacccggtgattgcagccgccatattggaggagccggtggattggggcagggacaggagcgtggaccggatatttcttctggccctgaatctggatgaacggtttaaggcaaagggacaaatcatccgtttttattccgccattgtcacattgctggatgacaaggaggcctatgaggaattccacggcctcaggggacaggaagaaattacagattatttaaattctatggtaaaaggagacaggagagcatgaatctgctggaagtaatcaatgaaaatgcagtggccgtcaatgtaagggcgcagaataaggaggaggtgtttgaatatgtgtgcgaccttcttttaaaggacggcagcattacatccaaggaagcgttcaagcaggatttatatataagggagtcacagggaaagacaggcattggggacggaatcgccattccccatggaaagtcggcggctgtgaaacgcaactgtatatcggtccttaagctggaacgacccatacaatgggagactctggatggcctgcctgtgcaggtgtttatcgtatttgccatcaatcaaagggataaggatgactacttcctgcgcctcatggccagcgttgccaagaagctggcacaggaagggacatgcaaaaaactgatgggaagcagcacaaaggaagacattctggaagcattttgttaggctgcttcactggattcgcggaatacaggagcagcgtgtttatgacgaacaggaggaaataaaggatgaatatagtaggggttacggcatgtacggcgggcattgcccatacatacattgtcaaggaaaagctggagcaggcagccaggaagctgggatacacatgcagaatcgagacacagggaagcattggaatcgaggaacagctgacaccggaggaaatccaagctgccgatgtggtcattttggccattgacgtgaagatttcaggggaaaaccggtttaagggaaaaccagtggtgcgcatgagcacggagaaggctatgaaaaataccggagcgctgcttcagagcattgaggaagcgctggcaaaaaagaaaaacggaggggattaagattatgggtgggtttaaattatcagagattaagaagcatgtgatgacaggaatatcattcatgattcccattgttgtgggcgcaggcttatgtatggcactgggaaccgccattggagggaccaaggtatccgaggcagagggaacactgatatggtatatctggaggaccggtaaggttggtatgggctttgtggtgcctgtgattacggctgccattgcgtattccattgcggacaggccggctattgcacctggattgattctggggtccattgcttcggagatttataccggattcatcggaggcattatagcagccttccttgtgggctatacagtgctgtttctgaagaaatatctgaaggtgcccaagaccatgcagggtctggttcctgtacttattcttccgttcctgaccacattgatttgcggtgcccttatgtttgctgttataggaaagccggttgcttttgtcatcaatgcattgcagaattggctgataggacttcagggcggttccaaattcattctgggagccattgtgggaggcatgtgcggcgttgactttggcggtcccatcggcaagacagcttctctgtttgcaaacggcctgctggtggacggcatatacggtccggaggcagtgaagctggttacatgtatgattcctcctatgggcgtaaccctttcctacattctcaccaggaacaagtacacaaaggctgagaaggaagctgtaaaggctgcgttcccaatgggtatatgcatgattacagaaggcgtgattccgttggccatgaacgacccgttgcgtgtaatcggatcttccgtgattgccacatccatagcaggaggactcaccatggtgctgggaattgagaattatgtaacggcaggcggatggttcattatcccgctgtccaataaacctttgatgatggctgccatggtagccatgggaggcgttatcatgggagttatactttccctgtggaagaaggtggtcacggaagacgattccatggattttggcatggagcaggaaaacggggaaaccaccaccgatggaatgacatttgagaacttttagcgacatcacagatattgtctgataggaggataaaaaatgctgctgaatctgcagaaaatactggagcctgctgtaaaggggaattttgcagtgggagggttcaatgtaacagaaagcactatgttcaaagctattgtggaggaagcggaacacttggaatctccggctatcatccaggtttcccccaatgaatttcagttttcggagcgggaactgtacctgtacttttcggtccgcctgcagggcagcaggaatccatttgtgcttcactacgaccacagcaagtcctatgatgggtgcatccgcgccattcaggcaggctttacctctgtcatgtttgacggctcgcagatggagtataaccagaacgtggaatgcacccgccgggtggtggaggcagcccatggggccggcgtgtcggtggaaggggaaattgggaccataggggagacagcggactatgccggcggcacggtccgggatatggtatacacatcaccggagctggccagacggtttgtggaggacaccggagtggatgccctggcggtttccatcggcacggtgcacggcattcttccaaagggatatgtgcccagactgcagctggagcttctgaaagaactggctgccgcggtgccggtgcctctggtgcttcacggtggttccggcacgccccatgaggaggttgccgctgcctgcaggacagggattcacaaggtaaatatatccagtgagttcaaacatgcctattaccagagcgtaagggagtttgtgacaaatcatcccacccaggtcagtcccaccctggttcttaaggatgcagtgcaggaggtaaggaaggtggcagggacaaagatgcaggtactgggctgcgccgggaaggcatattgctacataaaataatatcaattaaggggagtacataatgtatacagacatcaaaacaattcttgacgatgcaaataaaaacaactatgccgttctggctgcatccgcatttaacatggagctggccaggggactgatagcagccgcggatgaaatgcaggcgcccttaattatcctgatgggccaggcccagatgacgaaacacgccaggccggagctgatggtacccatgatacggacgcttgcagagcagaccaatgtgccggtggccctgattttggaccacggcagggactgggagaaaatcacctgggcttacagacagggattttcctccgttatggtggatgcttcggcctatgagatagaggagaacattgccaggacgaagaaggtagtggacctgtgccatgtacaagggctggcagtggagggcgagctgggccatgtagggcaggccgccaccctggacggatgcgacgaggcgctgtatacaaagccggaggaagcagtgcgctttgtgcaggagacaggggtggacagtctggccattgcctgcggcactgcccatggaaattaccccaagggctttgtgccaaccattaactttgatgtcataagaagggtgaaacaggcggtaaacatgcccctggcactacacggcggctccggttcaggggacgagaacatccgaagggcagtggaagcaggaatcaacaaggtgaacattgccactgagatattcaatgcgtgcagggattacgtaaagacccgtctggaccaaaagccggacctggattatatgtcccttatgatggaaacggagcaggagtgtaagaaaacagtaaagcattttatcggcctcacagcatctgagggaaaggcagccggtttccggaagaagtatgcattctgccacggaatcagccagattgatacagggattggcgaataaggggacacgccctaatccgtatgcctgcgtctgtactggatggggctgcagccggcctgctccttaaagacacgggaaaaggagctgaggttggtgtatcccacggcctgtccaatcatttccacggaataatccgtgttgatgagaaaatcttttgcccgggtgatgcggtattctgtaatatagtcgctgactgtcatgccggagatttccttaaaaacattataaagctgggtcttgctgactaaaaacagacgggacaggctgtccgtggtcagattttcactgtaatggcctccgatgtattcataaatatcatataccaaccgggcgtgctcccggtaggcagatgtgctgagggggccaaaccgctctgtgtagagctggttggccagcagaagaaattcgcccagcaggaatttaaggtgcaggtcccttccataagcaggcgcagggtccctgcctccatccggcctgttataatactccatcctggaaaggacggaaagaaaggctcccatctgccggtccggcaccgtgaggaccacgggctggttgccggggcgaagcaggaagcactccagcagattaacttccggtgtggagaactgggatatgtaaccggaggaaaaatacagcacatagcggtcgcagattccggacccgttctctgaatagatataatgcaggtccatctggttaaacagaatcagcccatttctgggaatatcaatcacccctgtttcaaacttacattttaaattgccggacagggcaaacacaatttccatctgtctgtgcaggtggaaatttcgcttttctgttgtcccggttatcttgtgccgaactgagaattcttccggcagcttttccgtatagcgtgaaaatggaatgtccatggcgcctcccagggtatctatgcaatcatatgaagcacttcttagtatagcatggtttgaagaaaatgcaaagtatatggacaatctgcaaaaaaatgtagaaacacatggtatataatacaaaatgtaaggaaaacaaggaaaagttaagccggtattcatggaaaatataaggaaaaagtcaaaatgattgatgaaattgtaaagagcacaagggaagcctgcgccgtgctggaacgtataaaatccatgccgcgtgaggaattggaaaaggcagaaattctgccgctgctgagaaatgccgtgaacctgaagcttatgattcaggaggatacccagacagatatcagaaagcttgtcatcatgagcatcaagcgccaggatttgcaaaagggaaacctgccggatgatgtgattcagagggagataaagaaatacgactgtcatcagaccagcctggcggcacagaaaaaggtattgctgcttatgtttattgagaaggagctggggattgtaatgggggatgatgaggccacggatatagagagtctggatgaattggctgaagctgttataaggcacctgaaagggggaggatgatatggatgcagataaaatccgcagggattttccgattctggaccaggagggtgggccctttgtctatctggacaacggggcaaccacccagaagccccaggctgtcattgaccgtctgtgcaggtattattcccaggagaattccaatatccacaggggaagttatcccctgagcagccaggcgtcccgcatgtatgaaagggccagggagacggtccggacatgggtggatgcagagtatgcggaggaaatcgtctttaccaaggggtgtacggagtcagtcaatctggctgccgcggctgtatttgagacatatgtccggacgggggacaatgtgattgtcactgagctggagcattcctccaactatttcccatggaaaagccaatgtgagaaaaagggcgcagagcttcgggcagccttggcagagagcgatggaagcctgagggcggacgatgtgctggagctggtggacagccgtaccagactgatagccgtcacagccatgtccaatgtgacgggattttgtccggatgtgaaccggattataaaggaagcccacagaagaggcgtactggttctggtagatgctgcccaggccattgtgcaccaggtcatatccgtaaggcgtatggactgtgattttctgtgcttttccggtcacaagctatacgggcccatgggaatcggggtactgtatggaaggaaggtatatctggaggaaatggccccgtatctgtacggcggggacatggtggtaaaaggcgacaggggagagatttcatataaaaggtcctccggaaaatacgaggccggcacccagaacattgcaggggcacttggattggaggcagcccttgtgtatctccaaagtctgggcatggaggagattcttcggtatgaggcggaactgggcgcatatctgagagagtgtctggaggcggttaagggggtacacataatcggggagtatgaaggggcgctgcaggttccgcccatggcagtgtttgaggctgataacctgggagcctatgacataggcgttctgctggccaattacggaatagcggtccgctgtggttcccactgcgcctacccacttatgaagcgcatgggaaaggaaagcctctgccgcgtatccctggctttttacaatacaaagcaggagattgcatatatggctgaacggctggaacgtatctgcgggaggggaagttaatggatgggagataccagaaggatatgcatcagatagatatgcatgaaatggacatgttccaggctgaggcaaaacatattgacaaccttatccaattacaggacccaggctcccagtgcgagtatcttcttatgcttgggatggaaaagcttcctttggactccctgcgcggggaccggtacaggattggaggatgcaggaccgcaatctgggtccgggcagagaaacaggacgggagggtgcatttttccagtgacagtgattccctgctggtgcggggcgtgctttccattttagaagagctgtaccagggaagaacgccggaagccataaaatcccatcccatgaaattcctggattatatatccgacgatgtgatttatcctgaaataaaggaaaatggattatcaaaatgttatgggatattagcacatatgtaaaataaaaaaacaatagaagcaatgaaaaaggtataaaaggagaaaacaatcatgaagtatgcaatggacgttaaagttaacttaaaaccgattttcagcaatctggtacacactgactggtgggaaggcccttgccgggtaggtcccatggaagaggggacgccggagtttgaacgcagggtaggaaaggaacagtttaaaatctggtacgaggaattacagaacaacctggatttgacccgctgccatctgatggagccggcctacctggaatttgacgagagctttgtgatgcgggattctgagtttgacaagctgatgcctgaaaaccatcaggtggatttgtatctgattacataccgcgtacccggaattgagcgtttgaacaagcccatttccatgattaatctggggcctacccccatcgaccttgtgggttattacagggatatcggacttgaggcatatatggcccatgactacgaggagtacaaccgccttctgacctgcctccaggtgcgtaaggcggttgccagcacaaaaatactgattctgtccaattccgagcagacgccggcgtcggttaataccagctgctgcgacctggtaagcctgtttacacggtacggcatccgccataaccgcattgacttcaggcaggtgtttaactattttgatgagataccggctgacgagggaatccatcaggaggccagggctctgatggaaggggcggataaagtggatatcacagaggaatacctgtgcaacgacctgaggtatttccatgcggtgcgcagcatgatggagcgctatgactgcaatgcattcaccaccccgtgcaaggagctgtgtgcaagccggctgccccagaagaataaatgtgttccctgtattacccattccctgaataaggatgacaggattccgtctgcatgtgaggaggacctggctgtatggatggccatgatgatgatgatgtacctgacacgccagagcgtgttcatggggaatccggtgctggtgctggcagggagcaagaccctggaacagctgggaatgcctaagcttctgacacagcccggccaggtatttgaccacgatgtgctggaaatccaccacgctgtgccggtgcgcaggatgcggggttttgaccagccggagcagagctatgagctggcgcattttaccacccagggctggggcgcccattaccatgtggatatggcagaggaggacggacaggtggttacatttggccggtttaaccgtcagggaaccaagatgatggtgactgtcggccatacactgggatgcgagttccgccccgtatactgcagtcctgctgtgtattacgaggtagagggcggagccagggagttccgccaggcattggcaaagggcggttacggacatcaccaggccattatttacggcaatcatgtaaaggaattacaggagctgggcgaaatcgttggttttgaggtggaagtattccactaatcagggagaggaacatggcttattatcagagaaagcaggatgtaaacgaaattgcggcaggaaatggccacggttcctttccccttttgggagagaaacagggctgtaccaacggctgctgcgccggaatcagctattattcccgcacagagtatacgccgccagcagtccatgaggaccaggagggcttcatggtcctgtcaggacagggatgggccaaaatcggggaagaggaatttttcgtggaacaaggaactgcatttatagcgcctgaaggtatgcctcaccagatgaagagcgcggacagcggggaacccctcaccctgttctggttccatgcccagccttaagcggatacattcattaaatttttaaaacccccttgacatttccgaaaaaaaaggataaactcaatgaaaattcataatgaatgcggaacagctcgaaagggagtagtttagatatattgtcaacaacctcggttccaccggaacctggcaatatatgcctttacggttacaagacttttatgcgtggtttgcagatatgttacatatcctggcagccatccatagaagtctttttttgtgggtttcctggcaaaggaacagagcagataattgttttctgctgtgctccgggcattttggcgcagggatacgcgcataatagagactaagtactcaataatgaggaggaaagtacatgaaagaatggtatcaacagacaaaagaggaaatactcagccagtttcaggtaacggaacaggggctgacctcttcgcgggcagaggaaatcctggctgaaaagggagaaaatgtcctggaagagggaaagcgcaaaagcaccctgcaggtatttttagagcagttctgcgacctgctggtggtaatcctggtgattgcagcccttatttccatggtgtcgggcaatgcggagagtacggtggtcattctggccgtcatcatccttaacgccatcctgggaacagtacagcatgcaaaggcagagaaatccctggacagcctgaaatccctgtcatctcccaatgccaaggtgctgagggacggacagaaggtggaaatcccgtctgccaaggtggttccgggcgatatcctgtatctggaagcaggcgacctggtggtggccgacggaaggattttggaaaattattccctccaggtcaacgaaagctccctgaccggagagtccaccaatgtggataagagcgacggtacccttcacaccgactgcgccctggctgaccgggccaacatggtatattccagcggcctggtgacctacggacgggcggtggtgctggtaacctccacgggcatggatacggaaatcggcaaaatagctgctcttatgaatgccaccaaggaaaaaaagactccgctgcaggtcagcctggaccagttcggcagccgtcttgctatggccatcatggtcatatgcgccctcgtgttcctgctgagcctgtaccgcaagatgcctgtgctggattccctgatgtttgcggtggccctggcagtggcagccatacctgaggcgctcagctccattgtgaccatagtacaggccatgggtacccagaaaatggccaaggaacatgccatcatcaaggaactgaaggctgtggagagcctgggctgcgtctctgttatctgttcagacaagaccggtaccctgacccagaataaaatgacggtacagaatatctacaccaatggacagaccattaccatagaccagctgaacctgaagaaccagcttcaccgttatcttctctacgatgccatacttaccaacgattcctccattgtggacggaaaaggtataggggaccccactgagtttgccctggtggaaatgggaagaaaggcaactgtggacgaaaacctgctcagggagctgatgccccgtctggaggagataccctttgactcagaccggaagctcatgagcaccaagtatgagcttcacgatgtgcccaccgtacttaccaagggcgccctggatgtgcttctggaccgcaccgtgaaaatccgcatggaggagggaatccgcgacatcacccaggaggacagggacgccatccttcagaagaatctggagttctcccaggagggcttaagggtactggcctttggttataaggaagttcccgaagattacaccctgtccctggacaatgaaaatgactttattttcctgggcctgatttccatgatggaccccccgagggaggagtctaaggcagcggttgcagacgccaagcgggccggaatcaagccggtcatgataaccggcgaccataagataaccgccacagccattgcaaagcagattggcatttttgaggatggggatattgccatgacgggccgtgaactggacgccatgccggaggaagagctggaccgcaggattacggatatatccgtctatgccagggtctcgcctgagaataaaatccgtattgtggatgcatggcagagacgcggctccatcacggccatgaccggcgacggggtcaatgatgcgcctgcccttaaaaaggcggacatcggagtggccatgggcatcaccggcaccgaggtctccaaggacgcggcggccatgatactgacagatgacaattttgcaaccattatcaaggctgtggccaatgggcgcaacgtataccgtaacataaagaacgccatcaagttcctgctgtcaggcaacatggccggtatcctttcggtattgtacacatccctggcagccctgcctgtaccctttgcgccggtgcacctgctgtttatcaacctgctgacggattctcttccggccatagcaatcggtatggagccggctgagaaggatttattgtcagaggcgcccagaaacccgaaaacaggcattctgacaaaggatttcatgactaccatcctgacacagggcggaatcatagctgtctgtaccatgattgccttccacacaggccttagaagcggcagcgcagccacagccagcaccatggcctttgcaaccctgaccctggcccgtctgttccatggatttaactgccgcagcaagcacaatatattcaagctgggcttttcttctaattggtacagcctgggagcgtttgcagccggcgtagtcctgctgggcattgtcatgttcgttccgtttatgcagaacctgttttccgtaacaccgctgacccaaagccagataatagatgtctgtctcctggccgcagtacctacggtgctgatacagatatttaaggtcatgagagatattaagcataggaaataatgggtaattgtggtataatgtccaagtaggcaatgagcggtgtacagcggcccggaccggccggaactcatcctacccaaaacaaaccaaccaaaggaaaggggcggtgcttaatggataaggtcataacagtaagccgcgaattcggaagcggaggccgtgaactgggggtaaagctggctgaaaagctggacatcccgttttacgacaaggagttaatctccatggctgcggacgatatcaatattgcagaagaggcattccagaattacgatgagcatattgtgattcacgacccgttagacaggcagtattaccatgctttttctgacatctacaaggttcccatgtcggaccagatttttgtggcccagtccaatgtcatccgcaggctggctgcccacggtccatgtgttattgtgggacggtgtgcagacatgattctggatgacagcattaacctgtttatctactctaagatgagggaacggataaagcgtatgcttgtcctggaaccagggtctgatgagaaggagatggagcgccgtatccgggaggtggaccggaaacgcaaggagtattaccagtattacaccggcaacacatggggccgggcccagaactaccacttatgtctggacagcggactgacaggggtggacggctgtctgagggcggtgctggcatatctgggagagctgcccgggtaaacccgcagggcagggtacggtatggataaaagtaccggcgtttcggctaaaacgagaattaagcaggacattttaaatttctaataatttaggaggcagaagatgaaacaggatatgattgtaattcttgacctgggaagcacagaaaacacaaaactggccagggacatcagggagatgggggtgtacagtgagatttatccccacgacatcacagccagcgaactgaaggaacttcccaatgttaagggaatcatcatcaacggcggccctaacaatgttgtggacaaaatccccatagatgtgcgcccggagctgtatgaggcaggatatccggtaatggcggcaggccatgccgcagcagcctgtgagcgttccatacagagctgggatgaggctgacagcgctcaggttctccgttcctttgtgttcgatacatgtaaggcccaggctaactggaatatgaagaacttcatttccgaccaggtggagttaatccgccagcaggtaggggataagaaggtgttactggctctctccggaggcgtggacagttctgtggtagctgccctgcttatcaaggccatcggaaaacagctgacctgcgtccatgtaaatcatggtcttatgagaaaaggagagtctgagagcgttatcgatgtatttaagaaccagatggatgcaaatctggtgtatgtggatgccgtggaccgtttccttggcaagctggccggagtggctgacccggagcaaaagcgcaaaatcatcggcgctgaatttatccgcgtgtttgaggaagaggccagaaagctggagggaattgaattcctggctcagggaaccatatacccggacatcgttgagagcggcaccaagacagccaaggtggtgaaatcccatcacaatgtgggcggacttcctgaggatttggactttaccctggtggagcccctgcgtcagctgtttaaggacgaggtacgcgcctgcggactggagctgggactgcctcacgctatggtataccgccagcccttccctggtcccggattaggcgtgcgctgtctgggagccataaccagagagcgtctggaagctgtaagggaatcagatgccattctccgtgaagaatttgcaaacgccggcctggacaagactgtatggcagtatttcaccattgtgccggactttaaatcagttggagtcagggacaatgcacgctgctttgattaccctgttatcattcgagcagtcaatacagtggatgccatgactgcctccattgagcgcatagattacgatgtgctgcaaaagattacagaccgtatattgaaggaagtcaagaatgtaaacagggtgtgctatgacctgagcccgaagcctacggctacgattgagtgggaataaccgttgaaacggcgcaaacccgccctgctgaacgacaaattcagcagggcgggttttacatacccccggagccacaagcgatttattgaagatggggctgattagaagcggctatactgacctaaccccagaagatgaagtggaaatggccagctttatctggccgattgtcagaggaatcatcaggactgcgattgaaaatcaccaaaaagaccccggcttgaaaaggagaaatactgtgaatacgcccaaaatagaaacagaacgtttaattttaaggaaatttacaggagaagatattgaagcactgttccttatccttaaagatgaagaagtcaacaaatttttgccttggtatcccatgaaggacattgaggaaacaaagaaattttatatggaacgatatgctgcaaagtatgcccagccgcaggcttatgcgtatgcaatctgccttaaaagcgataattttcccattggctatattaatgttgatatggaggaacatcacgatttcggttacggactccgaaaagaattttggcatcggggtattgtttccgaagcgggcaaagctgttgtggagcaggtgaaaaaggatggcctgccgtatattaccgcaacccatgacagaaataatccgagaagcgcaaatgtgatgaaagcttgcggtatgaagtattgctatacatacgaagaacagtggcagccgaaggacttccccgtgcttttcaggatgtaccagctcaattttgacggcaatgaagatttcgtatataagaaatactggaatatgtacgaaaagcattttgttgaagaaatattttaaaaccaatcctacgtacaaaaatatcttgtcaagcagaaaattagataagtttaaaaaaaatataaaattaactaaaattctataaaaattaaataaataattattgaatttaagggtcgaatatgataaaataaaaacaatctataaaaattcctttttctaacagcgctggtatagtttttttctttatgaataatctagtaccatgctggaggattcagggaaactccggggagtttctgtgagagcgcgaaagcgcaggacagatataagcgtccataaaatcttccatgctcacaggcaaaagggaggcatactttcccatctatggtgggtgtccctattgtatgtttacatcccgctccttggagcgctgattatatcagcacaaataaaaatgccgcggtatgcggccaattaaacgtatagggggaattaggaatggacgttattacaaatctcgtagcaaaaggtaacagttttctctggagttttctgttgattgttcttctgtgcggcactggtatctactacacaatccgcctgagattcatccaggtgagaaagtttactgaaggctggaaactggtattcgggcacctcagccttaatggtgagaagcacgaaaagggtgagatgacaccgttccagtcaatcgcaactgcaattgcagcccaggttggtaccggtaacctggcaggcgctgccacggctcttttaggaggcggacctggcgctattttctggatgtgggtaagtgcgttctttggtatgtcaaccatttacgcagaggcaactctggctcagaactttaagactgaggtaaacggtgaggtaaccggcggtcctgtttattacataaaggcggcctttaagggcaccttcggcaaggtcctggcgggcttatttgcaatctttattgtgcttgccctgggattcatgggcaacatggttcaggccaactccatcggagctgcatttacagaagcatttggagcatttaacataacaatctcaccagtcatcataggcgttatcgtggcagctattgcagcatttgttttcctgggcgggacacagaggcttgcatccgttgttgagaaggtagttcccatcatggcaggcgtgtacattgtgggaagcctgattcttattatcatgaatattgccaacgttcctgcagccattaagatgatttttgtaggagcatttgacccgcaggctgtattaggcgcaggcgcaggtattgcagtaaaagaagccatccgtttcggcgttgccagaggtcttttctctaacgaggctggtatgggttccacacctcatgcacatgcaagggctactgcggagaatcctcataagcagggactttgcgctatgattagcgtattcatcgacacgtttgtaatccttaacctgactgtattttccgtactgaccacgggcgctcttgagtccggaaagaacggtactgctcttacacaggcagctttcatgagaggattcggctcctttggtattgtattcgttgcagtctgccttttcttcttcgcattttctacgattctgggctggcatttctttggccttatcaatgcgaagtatctatttggcgatagtgcagcaaagatttattccttattggtagtggcttgtatcataatcggttccgctctgaaactggagctggtgtgggatttggcagacttctttaatggtctgatggttatacccaatgccatggccttgcttgccttaagcggtctggtggtacagatatgtaataagtacagtagtaaataacacctgatacagtaaaataaatggtatttttgcggcagcttttccggaatatccgggggagctgctgctttttcttttcctttttgcagcgaatgaaaaatttagttattgggaagtatttatggtaaaagagaaagcagaaatgaggaattaaatcatgattgactccattgcaaagataacgctgtatgtgaaaaatcagaatgaagccagggatttctggacagaaaaaatgggattcatcgtgcgtctggaacagcagatgggagctggacagaaatggctggaggtagggccggaatacggaggcgggacatcctttgtcctgtatgacaaagaaatgatgaaggcccagaatcctgaagtaaatgtgggccacccttctgtcatcttatgcaccggggaccttgaaagcgcccatagggaaatgaaggagaggggggtcctggccggggatatcatgaggatgccttacggcagcatgttccagttttatgatatggacgggaatgtgtttttgctgagggaggaagtcggtacacattaagtttccgtgtaatttccaggcctgtttttctgcgaaacgccgtgcatgtatttgtaaaccggtataaaatatgttagaataagtagcattagagcatacggcgataaccgggaaaggatgtagtcaggagaatgcagaagtccaacaaaggagaactgtccaacctgaaaagcaaactgctggcagaacaggttcaggagcagatatatcagtatatattggatacacctatagcagtaggcgctaaacttcccaatgaatttgaattgggagacaggttcagcgtgggaaggagtactatccgggaggcggtaaagcttttgatttccagaggaattctggaagtcagaagaggctccggcacgtatgtggtcagcaccacgcccatggatatggaccccctgggcctgggcgcagtggaggacaagatggccctggccctggatttggtaaatgtccgtatcatcctggagccgggaatcgctgagatggcagcgctcaatgcaacagaggaggacgtggagaagctgcggaatctgtgtgacagcgtggagcggaagataaagattggggacagctacatagaggacgatattgccttccatacctgcgtggccgaatgctccaagaataaggtggtggagcagctgattcccattattgacacagccgtccttatgtttgtcaatgtgacccacaaaaagctgacggacgaaaccatcatgacccacagggcagtgacagatgccattgcagagcatgaccccattggcgcaaagacagccatgatgatgcatatgacctttaacaggaatatgattcggcagctgatgaaggatgggcgtgaggcataggggtgggtatattggaaatcggcgatatgaaatatgagtgacattaaaaatcagaaatatcaataagcagtaatacctataagataaagtatctcccggaaacagataaaagggaatacttatacttataggtatttttttggttaattgaaagaggaaaataaatacatctgacgactttttacgctgacgtaagacgcacaaggcaaaaaaataagaaaaatgggatatactggaaattcagcagcgcgaaattgtgtatagtgcacaattttgctaaattcttttgacaattaagtagaaaacaggtctgatgacttgaaagaataatccagaaatgctactataaaactacaaagaagtcagacgtcagatgtgaagagaaagaggaggcattttatggaactgaacagtcaaagagtaagagcgctggcaccggagaacgacccgttaaaaatcggcatggggtggaaggtggaagacctggacaagccgcagattatggttgagagtacatttggggacagccatccgggcagcgcccatctggaccggtttgtaaacgaagccatgcgtggaattacggatgcaggcggaaagggagccagatattttaccaccgacatatgcgacggcattgcccagggacatgacggcatcaactattcccttgcacacagggacatgattgccaatatgattgagattcacggcaattccactggatttgacggaggtgtgttcattgccagctgtgacaaatccgtaccggcttgtctgatgggactggcaagacttgatatgccgtccatcgtggtaaccggcggcgtcatggatgcaggccctgaccttttgaccctggagcagattggcgcttactctgccatgtgccaaaggggtgagattacagaagagaaactcacctattataagcacaacgcctgtccatcctgcggggcctgctcttttatgggtactgcctccaccatgcaggtcatggccgaatccctgggtctgatgctccctggctctgcgctgatgcctgcaacctgtgaggatttgaaggaaatggcttataaggccggacttcaggttatggaactggccagaaaggggcttaaggtaagcgatattgttaccatgaaatcatttgaaaatgctatcatggtgcatgcagccatatccggctccaccaattccctgctccatatccctgctattgcccatgagctggggctggagattgacgccgacacatttgaccgtatgcacagaggcgcccactatctgctggatatccggcctgccgggaagtggcccgcacagtttttctactatgcaggcggtgttcctgcagtgatggaagaaattaagtccatgctccatctggatgtgatgacagttacaggaaagactctgggagagaatctggaagagcttaaggccaatggattttatgacaaatgcgacggatacctgaaaaaatggggtcttaagcgcaccgatgttatccggacctttgaggagcccattggaacagacggaaccgtggccatattaagaggaaatctggcgccggagggttccgtggtgaaacattcagctgttcccaaggaaatgtttaaggcggtcctgaaggcaaaaccctttgactgcgaggaggatgccattgaggcagtcatctccaggaagatacagccgggagatgctgtgtttatccggtatgaaggacctaaggggtcgggaatgccggaaatgttctataccacagaggctatttcctcagacccggagctgggcaagaccatagcccttatcacggacggcaggttctccggggcatccaagggaccggccatcggacatgtatcgcctgaggcagcggacggagggcccattgcactggtggaagaggatgaccttatccggattgatatcccggaacgcgtactggaaatcataggcgtaaaggggaaggagcttcctatggaagaagtggagcggattcttgcagagcgcaggaaggcctggaaacccagggaggccaagtataagaagggtgttcttaaaatctattcccaacatgccgtatccccgatgaagggcggatacatggtctgattgccgtagcaggaaaatattaaggtaaacatatagggaaaatagggatattgtgtgaaattataggagggtaataagtatgacaacaacgactgctgcagctctggacccaaccagactgattatcgctgccctggcagggctggtaattctgctgcttttaatcatcaaattcaaggtccaggcaatgatttccattctggtcggtgcagtggccatcggcctgattgcaggtatgccgtttgcagatatcatcagttctgtcaatgaaggaattggcagtacacttaagggaatcgccctgcttgtgggcctgggttccatgttcggctccatattggagatatcaggaggcgcccagacgctggccgttaccatggtgaagaaattcggcgacaggaaggctgcctgggccctgggaatcacgggtcttgtcatcgccatgcccgtatttttcgacgcaggactcatcatcctgattcctcttgccttttctcttgccaagagaaccaagcgctcctcactgttttacgccattcccctgctggccggtctggcggtaggccacgcatttatcccgcccactccaggtccggtgctggtggccaccatgctgggcgtggacctgggatgggtcatcatgataggcattgtgtgcggtatctttgccatgatagtggccggccccatatggggaaccatctgcggaaataagtacgatgttccggttccggaacatattgcaaaccaggaggattttgacgaatccaagcttcctaaattcgggacaattgtgggaatcatattgattccattggttcttatcattctgaattccattgcaaaggtggttcctgcccttgcctctgtacagcctgtattgggatttctgggcgagccctttgtggcccttaccattgcaaccattgtggccatggttcttctggggtaccgccacggatacagcaatgaggagctggaaaaggtactgacaaagtccctggagcctaccggactgattctcctggtaacagcctgcggcggcgtgctccggttcatgcttcagaactccggtctgggtgatgtgattggcaatgcagtgtcctcagcatcccttccgattgtggtagtggcgtttgtggtggctgccctggtgcgtatctctgtgggttctgcgaccgtagccatgaccatggctgccggtatcattgcagccatgccggagattgcaaccctttcccctctgtacctggcctgcgtcacggcagcagtagcaggaggcgcaacggtttgctcccattttaatgactctggtttttggcttgtgaaatcactggtagggctggatgaaaagaccactctcaagacatggaccatcatggagacactggtgggcggtaccggatttgtggtagcccttatcatatccttctttgcataaggatggatggtgtggttatatacggtcgttcagatatgaaatgagatatttagggggaggcagtcttcaggctgtctccccctttcagcgcgccgctatatgcccggcgggtcttcaggctggcttaatagtttttgcatctgggacaacaaagagtatttgttgtcaggcagttgtcctaagaaggtgtatttgtccaggaccgtggtatctgcaaaggcgcagtgttccagctccaggccactgagcaaatcgtgggcttcctccaggcgttcaagaggcgagagaggggtgaaagtaccctccctgcacatagatgccaggctggtgttaggccataccctcaagcctatgaaccatacccttgcaggctgtactttattcaggaaagcaattgtgtcattcacatgttggccggaacattctttcccgcccagtcccggaatgacgttgagggaaaatgggataccggcctggcgtaagcgcagacaggcctcttccgcctcctgggccgtgattcccttattcatgagccgcagcacctcgttgcatccgctttccagaccaatatacagatgggtcagaccgcggcgcatgaggacgttaagctgctgcaggtcctttctcaatatgtcgtcaaacctggcatacatgcttatgccttccatccatggcatatgggaatgcacgatgtcaaagatggacagcagtttgggagtgtccatcacaaagggattctcacccagaaggaagacagaggttttgccggttgaatactgcgctaatatagcggcttttttttctatgtcgcccagagaaaaaacagaaaacttatcgttggaaaagtcacaaaaggcacacttgtgccagctgcaccccagggtagtctctaagaacgcactgtcattttcccagaaggggcggtaaatttcttcaccagtatacaatgatatattgtccataatgattcctttactcggatattatgctgtccgtacagttgggagctatctctatcttcagtaaatccagagctttgccgaccatgtgccagcggtaggtacgctcctccttcaggcttagtttgggatccccgaaaacatggcagatatcattaccgcgcaggatgcggctcacccccacgctctcggcaatcttagtcaggtttgtcacctgtattacaggtatgccaagacgctcgatttcttttccaatcaatgcaccgcaccgggtgctggtcccgcaggtggaggacaggacaacagcgtccacatcgcagtcccttagtgatacggcaattcgttctcccagggcagtaccgttttcaaccgatgtcattacgccggccgtggtgtagaaaatatcaaatagccgccctatcataccctcacgttccgcccttcgcaaggcatctatgggtaaaagccggttggggtcctgttctatatattcggtattataaccctgatgactgacctcgtagtccttggagagaagcatttcactgccgctcagagaatacatgcagaacttctgtgaatttgttgggttgagattatccgggtttcctttggggacaagcccgccgtctgtaacaagagcaatcctggcttttgccagttcctttttcaagttaggcatcagtatctcctgaaaaggcttcgcgggtacttctgtctcgaaattctgtttatgatatttggctagcagcatgtctatgccacgtttgctggcaggagttgcatagtcaacatttttgattgatgggtttttggagttgttatccaaacataatcaccagctttctataacctgtttctgtagaacatgataatacggtctttcttacatcatatagatttcgataatatatgtcaagatgcattttgtgcacgttgtacacggggggacaggaggaatattataatttgacaatagctgctaatggacatataatagatagatattattgatatatttgtaactattcagttgttttatctatgtgtgtaccaagttgaagttaatgaatgcaaaggaggagatgttcaacgtccagcagcgatataactaaaaaggcatttgcggatgcaatcaaacatctgcttaaaaaaaagtcattagccaagatttccgtaaaggatatagttcagtattgtaatatcagccgaaatactttttattatcattttaaagataaatatgaattgataaactggattttttatacagaaacattggcagaagtcaactccttcaatgaccccagcaagtgtcaggacagttttataaatctgtgcaggtatctgcataaaaaccggagtttttacctgagctgtttccaatatgtgggccagaattccctgagggattatttgcagaatttttattatgagttgattcgcatgaacctcagtgttcaatattcagaggcaggaatcaggctgtcaagtgatgaactgaacctgatggcgcgtatggaggcttattcatatgtaggcattgtttttgactgggtcagggatggcatgaataacgattatgggcggtatttcgaccatcttgccagtatacgaaagattgagatgtcctataataaaatgactgagaaaagtatgatgcagaatcattgacaagccagtaagaggatggcgcagctgtgttatacccgtgatattccggcagaaaaccaccgttttggaggttttctgccggatttttaatgcagtcctaccatatggcctgtatgtgactattgtatgcctttgacggaataagtgtattacactttgtgaataatgtaatatttttgcgcactgtagcaagtctgtaaattgattatggtggttatccatactacactgaaagaaaaagaaatgggggtaccgaggaatgaatggtaaacaggaaacaaacaggtgggcgatactggtgtacggtatgatttgcatgttgattatgggcatatgttatacatatagcttatttcagccctatatcatggaccacttttccgtggcaagtgcgagtgcaagccttccatacacgatttttattgccgtgttctgtgtgggaaactttttcggaggcgtcatgcagagaaagatgtccttgaagacagtgctgattattgggtatgggcttatgtttttagggtggttcgcctcagcagttttgccgccggacatgttctggtgcatgtttttgacatttggaggcctttttggaatcggagacggcattgtatataatgttatcgttgcactgatgccaaagtggtttccggacaaaaagggactggcatccgggctcacgcttgccactttgggaatcagtgcaacggtattttcacccatagtaagctcctggcttacaaattatggttatatgaaatcgttcatgatagtctcaggagtatacattgcagttggaatattcgggaccattacaatgaaggcacctccggccggatttatggaggattatgtatctgccggagccaatgtcagctctaaaaagcagtatacattaaaagaggcgctgcatgtaaaggaattgtatacaataaccggattatatttctgtgcggtaccagcttatctgctgcttagtgcgatttttgttacatatggagcggataagggacttacatcagccatggcaaccctgggcgtcagcattgcctcattgtgccaggttggcggacgcttcgtcattcctaccttaagtgataagataggacgtaaggcagcatttgccatttcctttttcattacagctggaggggttgcattattgacagttgcaacgggaaatctttatatgttctgcttctggctcctcagcttgtcttatggcggctgccaggcctgtttctcaccgattgcagcagaccggtttggaacaaagaatgtgggtgttatcctctctttcaccatgattggctttggcgtgggctccgtaggtgcatccctgcttgcaaaggtggtaggtatctctactgcattcatcggtgccggagtagttgcgctgcttggaattgtcctggtatttacgctgcctggcaagaaaagtgctgagaatgcatgataatatattacatgtttgacataggaaaggagtgcttaaattgagcaaaaaattgcagattgactatgtaagggtaaagaaagttcagttcggggacaaaacagttttagagaatgggatactgacaattaacaaagaggaattgattgacacggtaaagagtgagatgttcgggaacctggatatcaagatagcagtgcctggggagagctgccgcattctggccatacatgatatcatgcagccccgctgcaaggcggatgcgccggagacctcctatccgggtatctggggaaagcttgctcctatgggggagggacggacggttgctcttaagggcgtggtggtatcagacatctactatgcaaagtgtaatattaaatattatatggatatgggcggtccatgcgccaaatatacccacttttcaaagcattatcatgtgattctggatgcaacgccggcagagggcgtaagcgatgcaagctatgcagaggcattaaaatatgcgtccctgacaatcaatgtatatctggcaaagctgggaatcggccttacaccggatgagacagaaacctttgaattgggacccgtaggaccggggcctgatggaaagcctctccccaaggtggcgtatcttgttacccatatggcttcccatgatacatggaacttcctggtatatgggcagagcgcactgaactttttgccaatcattctccagcccactgagatactggacggagccatggtatggagatactgggagcctaattactatctgcagaatgagacatacatcaaggagctgctgagaaggcatggaaaggacctggaattcgtaggccttgtatttgccaataatgtgatgaagattgacggcaaggatgccatgggaatgatggcggccaccttgtgcaaagagacattgaaagcagactgcgttcttgtcaataagtccggcatgggacattgccagctggattcggccctggcctttaactggtgccagaaaatggggatgccttgcgtcatgaatctgtctgctgtttccaatgatgttcccggcgatatgctggttatctctgaccctaagattgacgcagttataaacagcggaaggaattacgacctgcagcatcccaaggtggaccgtgtgattggtaaagatgcaggtgttccgagtctgatgggatataatgttgagggaccatttacacacacaacaaacttcgcttatcagggaatctggtctcagctgggtgattgttatgtgacaacagacagcgatttgccggatgtcccggacactatgtaaacaggagggagaagaaatgtctgataagattcgtgtggttcactatatcaaccagttttatggcggatatggcggggaagacaccgccagcatgggaatcgtggtaaaagaagaacccgttggccccgggctgtatctgcagtcagcattgggagacagctataaaatagttgcaactattatttgcggtgacaattttattgctgagaatattgagaacgtgtcaaatgaggttgctgacattgtggaaaaatacaatgcccagatgtacatagccggccccggattcaacgcagggcggtacggtctggcctgcggagccactacggcagttgttactgaacggcttaaaatacctgcagtcaccggcctatatacggaaaatccgggcacagacctctacaaggacagggcctatatcctgcagactgaaaacaatgcggctaagatgaaggaggcactggaacgactggctggttttgcatctcgtttggcggagggcggttttatcagtgatggaaagacagaaggatactttggttctggtcctgccgtagatattgattatggcacacctgcaagtaccaggggcataaacatgcttctcaacaaatatttccatcagaatttcagaaccgaggtggtcatgccgaaccatgaagagattccggttccggttctggaaaagccgctgagtgaagcaagaattgcgttggttacggacggaggcctggttcccaaggggaatccggaccatatggttcccaccaactccaagtattttaaatcttataatttcggggatacagaccacctggatgcatctgattatgaggtcagccaccagggatataacaatgcgtttgtattggacgaccccaaccgcctggtacctgtggacgcaatgcgtgcccttgagaaggaaggaaagataggaagccttctggacacctattataccacggccggtgtcatgactcccatggagatggggaaaaagtttggtgaggagattgcaaagagcctgaaggaccagaatattgatgcggtcatacttaccagcacctgagggaccagctctcgctgcggtgcagtgatgacaaaagaaatcgaaagggctggaatacctattgtgcaggttaccaatttgactaagattgcagagggcattggttcccaccggatattccgcggcaacagcgtactccatgtgtttggcaatccgtccctgccaaaggagcaggaggtaaaataccgtaaaaaactggcggaagaagtgcttaccatgctggaagagacgcccggagaaggggagtccagcatgatacgcgaggaatagaaatgtgctgacagaaacaggatagaatcataatgatagaagggttccttttcgcagatattataataaggaaagggaaccctttttgcgtatcttccggatttataccgcttgttttttgtgtaaaaatgataaaaactatttacatctgcttatctttgtggtagtattatatatgtaaccggttacagattattctggcacggttacaggaaaaagagagggaaagggccatgaacattaaagagattgcacgccgggcaggtgtctcttccgctacgatttccagggtcctcaataattcgggatatgtgaaggaggaaaccaggcagaaggtgcttaaggcagtggaggagtacaactatgtgcccagcgccattgccagaagcctgagtatccaggacagcttaagtgtgggaaccattatcccggatattgaaaatgagtttttctccaaggtcataagcggaatcagcgaggtggccgagacatatcattataatattgtttttctgggaaccaatgagacattggacaaggaacatgactttttaaaaatcgtggaaagccagagactgaagggcgtaatcattacgccgatttcagagacggacacggttaccagggataatctgctccggctggaggaatccggcataccggtggtgctggtggaccgtgatgtgaagggagcccagtttgacggcgtttttgtggacaaccagaggggttcctatgacggggtaatggaattaataaaggcaggccatgaacggattgccatcataaccggacccgagacttccaagcctggcaaggaccggtgccagggctatatgcaggccatggaggacagcgggctggctgtgcctgaggcgtatgttgcctgcggcgattttaagattgccaaggcatatgagtgcaccggacggcttctgggactgaaggaaccgcccacagccatctttacatccaacaacctttccacccttgggtgtcttaagtatctgacggaacacaaggtgaagataggaagggatatttccctgatgggatttgatgacattgatgccctgcggatgattgactacaggatatccgtggtggacagggatgccagggaacaggggcgggaagccatgaggcttcttcaggagtgctttgaggattccgggaagaaccgccagagaggaaagcggattaccattccttatcaggtaatcctgagagggtcggagcaaaagaaaacaacctgacgattaggtcagattgttttctgcacaaatctgtaaccggttacacacagaacaaaagccattctatttttttactgagatgtgtaaccggttacagaaaatatatattacaattttaacctatataagcttcaaatggaaaaggagaatgaaaatgggaattgcacacatgattgaccacacgatgctgaaggcagatgccggtaaggataccatcattcgatactgcagcgaggcaagggaacataaatttgcctctgtctgtgtcaatacctgctttgtgcccctggtggcggagcagttaaagggaagcggggtaaagacctgctgtgtggtagggttccccctgggagccatgcttaccacagcaaaggcctttgaagcctcagaggctgtaaaggcaggggcggacgaggtggatatggttatcaacataggcgcccttaaggacggggacgattcctttgtggaggaggatatccgggcagtggtaaaggcttctgcaggcgcagtggtaaaggtcatcatagaaacctgtcttctgacggatgaggagaaggtaagagcctgccggctggcagtgaaggcaggggctgatttcgtgaaaacctccaccggattcagtacaggcggggcaacggcagctgatgtggcgctgatgcgcaggacggttggagaaagtgccagggtaaaggccagcggcggtatccgtacgccggaggatgctgcggccatgattgaggccggggcagacagaatcggagcaggcaacgggattgtgctgatatagcgggcacacagccaggatggattaaggagagaaatcatatatggaacatttgggaaagaaagtaacggtattcggcagctttgtggtggatttgatgggcaggacgccgcacctgccggcagcaggagagacggtgaagggaaccgtgtttaagatgggtcccggcggaaagggattcaaccagggagtggcggcccataaggcaggagcggatgtgaccatggtgacaaagctgggtcaggatgcatttgcagacattgcccttaataccatgcatgagcttcacatggattcgggaagagtactgtattccaagacaacggagacaggatgcgccctgattatggtggatgaaaacagcagccagaacgaaatcgtggtcatactgggggcctgcaataccattacggaccaggaagtggattccctggaggatttggtgggacagtccgaatatctgctgacacagctggagactaacgtatcctctgtggaacgcattgtggacatggcatacaggaagggcgtcaaggtcattttaaatacagctcctgtgcagcctgtcagtgatgagcttttgggcaagattgacctgattacgcccaacgaggtggaggcggagattctcacaggaatcaaggtggacagcgaggaagcagcggataaggcggcggactggttcttttccaagggcgtaaagaacgtgctgattacactggggcatcgcggcgtatacataaacacgggagaaaagaagggaatcatacctgcctataaggtggacgcagtggataccaccggcgccggggatgcatttaacggcggccttctggcagcgctgtcagagggaaaggatttgtgggaggcagctgattttgccaatgccctggcggcgctgtccgtacagaaaatcggcaccacgccctccatgccggtcagggaagagattgacgcatttatggcagcaaaccattgacatcagtaacaggagaaggggaaacgaacatgttaaagacaggaatattacatccacagctggccagggtgctggcggaactgagacacaaggataccattattatcggagacgcagggctgcccattcccaggggagtggagcgcgtggacctgggctggaggcccggtgacccggcttacctggatgtacttgaagaaatacttaaatatatcgtggtggagggagccgtgttcgcggatgaggctctgactgtgactccggacttccacaagaaggcgctggcccttctgccccagggccttccggtggaatacattccccacacagagcttaaggagcgcagcagggatgccaaggccattgtccttaccggtgaatttaccggatacaccaacgtgatattagtggctggatgcgcttactgatacagccctggtaaaaggggtgctctcaggaactcttagcagcaagggaggggtaacatggaagaaaaattagtattgcagatggattcaattgtgaagacatttccgggtgtaaaagccctggatggagtccatctggatgtgaggaggggcgaggtgcacgccctgtgcggtgagaacggcgcaggcaaatccaccctgatgaaaatcatagcaggagcccagggatatacttccggacacatgtatgtcaatggggaggaagtggtgttccactccaccaaggatgcggagcgcaagggaatcgccatgatataccaggaattcaacatggtgcgggacctgtccgtggcggagaatatgtatttgggaaggcttccgaaaacttcctacggcgcagtggactggaagaagctgtacaaggacgcccaggaggagctggaccgtctgggtcttaagtttgactgccgcaccaaggtgcgcaacctgtctgtggctgaatcccagatgacggaaatcgcaaagtgcctgaccataggcgccaaggtcatcatcatggacgagcccacggctgccctgacagatgaggaaatccgtatcctgtttaaaatcatagcggagcttaaggagaaggggatttccattctgtatatctcccaccgaatggatgagattttcgagatttcagaccgcctgaccgtgttcagggatggaaaatacatagcgaccaaggatataaaggacaccaactatgacgaggtggtttccatgatggtgggtcgcagtgttaccaacctgtaccctgagagggattacaggcaggatgaaactgtgctggagcttaaggatatctgcggcaaaggcgtccgcaacgtgaacctcagcctccgcaggggcgaaatactgggagtggccggacttctgggctcaggcaccatagagctgtctaaaatcgtgtacggggcgcttcccatggagtccggagagatttacataaacggggaaaagaaggactgctccagcccaaagaaagcgttgaaggcaggaatcggatttgtgtccgatgacaggaagcaggaagggctggtgctcatacgcaatatcagggagaatgtttccctgtcatccctggacaagataacccatttcattcatctggataagaagctggagacaaaacagattgacgcgcaggtcaggaggctcaacattaaaatcagcagcctgcagcagctggcaggtaaactcagcggcggcaaccagcagaaggtggtatttgccaaggtgctggaggccaacccgtccatcctgattctggacgagcccacccgcggcgtggatgtgggggccaaggcggaaatctatcaaatcatggatgagctgaccagggccggaaaaagcattatactgatttccacggacctgcccgaggtcattggaatgagcgaccgggtggtcatcatgagggaaggccgtacggtcctggaaatacccaagtcagaaatgaatcaggaaattattttagcccatgcatccggaggtgtcagcgaaaatgaataatataaataagaaaaaatgtatcggccagctcaatatttaccgttccgtactgattttactggtaatctgcgtatttgcaaccatattgtcccccagctttttaagcgtggccaacctgtttaacgtgtttaagcagattacagtggccggtattgtgggatgcggcatgacctttgtcatcctcaccggaggaatcgacctttccgtgggctccatcctgggcctggcaggcgttctggcctccggcatcctggaatccacgggcaatgcgggcgcggccattctggtggctctggctgtaggcataggatgcggcgctgtaaatggtttttttgtggcagtgtgtgagattcctccctttatctccaccctgggcatgatgaccctcctgcgcggatgcatcctcgtttatacaaaaggctcccccattcccattaaggtggatgcctacaaattttttggcaagggtacagttgccggggtgccggtacctgtcatcatccttatcatcctcttcctcattgcccactatgtgctgacacagaccagctacggccgcagcatctatgcctttgggggcaatcgggaggccgcgcgcctgtccggtatttccgtccgcttcacggagtggatggcgtatacgctcaatgggcttatgtgcggaatcgcaggcgtgattctgacggccagactgggttctgcccagtccaccagcggcaccggcattgagatggacgccattgcggccgttatcctgggcggcacatccttaagcggcggcgtgggctttgtgctccccaccgtggtgggcgccatgattatgggtattattgataatatcctgacactaatgaacgtaaatccccatgccaccaacattgtgaagggtgctgtcatactgattgcagtcctggtggacaagaaggtgaaggatttgtctgccaaggcagaatagaacatgcccggaaccgggcgcagaggatatggtacctatggtctgccataccgcccatggtgcggcgggctgttatgcaaatttcataaaagaaaaggagaatgtattatgaggaaacaaattggggcaactgtactggcaatggcaatggcgtgctcactgatggctggatgcagctcaggttcaggggacaccaccgcagcggccgcagccgcagcgactgaggcagcaaaggacgaggcaaaggatgaggccaaggagcctgcttccgaggcggagaaaaccggctcagaagagggaagcggaaagaaatatgtgattggccttgccatgaacacgcagaccaacccattcttcgtggatgtaaaggacggagtccagaaggctgcggacgagcatggaattgagctctacattaccgatgcgcaggacgaccccaccatccagatgaaggacgtggaaaacctgattacaaaaaaaccggacgccatcatcatcgatacctgtgattccgacgccatcgtgtcctccatcgaggcatgcaatgaggcggggattccggtattcaccatggaccgcgaggccaatggcggcgaggtcatttcacatattggctatgacgctatcaagtcgggccgtatggctggacagtacctggttgacacattaggcggaaagggcaaaattgttgagattcagggcattatgggaaccaatgttgcgcagaaccgttcccagggctttaacgaagtcatgaaggacaatcctgatatggaaatcgtagcctgccaggtagctgattttgacagggccaagggcatgagcgttatggagaatattcttcaggctaatccggaaatcgacggactttacgctgcaaatgacgaaatgctgttaggagcgctggaggcaatggaagcagccggaagaaccgatgaaatcgtaaaaatcggctgtgacgccatcgatgataccctggatgcaatgaaggctggcaaggttgacgctaccatcgcagagccgccgttcttcctgggcaaagccatcctgaacactgcctatgattatctggaaggcaagcaggtcgagccttatgtaatcctggacaaccagctggtgacacaggaaacagtggacagcctggtaacaaaggaataatttaccggcagttcttgcacacaggaaacagaataatttcaggccatcggctcatactatgagggtacaaaggaagtacgaatcagaaacaggtgagtccatggaaaaacccggtaagaaactgaagaaattattaattataacaggaaccacgggagcggtgtatgcaggatttaaatacctgctgcccctcgtggctccttttttcgtgggttatatcctggccctgctgctgcggccttcggccaggtttctgtcctaccgcatgaaaataacggtaaggggaaaacggcatcatatgcccatcggcgtcatcggcggcgtggaatttctggcagtgctgtccgtcctgggagcagtgctttacagaggcgccctgaagctgtgcgcagagggcaagctgcttatggtacagctgcctgtgtggctggaacagtttgatgtgtggctcacaggaaactgccacaggatggaacatgccatggggctgagggccggctgtgtggcggacatggcaggggacatgctctatcatatggtagatacatgcaaaacagccgccatgccctttctcatggccaactccatgtctgtaatcagctgcctggcaaaaggagccattgtaagccttgtggtgttcctggcagccatattaagccttcaggaaatggaggacctgcgggaccgccgggaccagtccgccttccgcaaggaattcaatatgattggaagccgcctggtacagacagggaaagcctggttcaggagccagggaattattctgttcataacaacgggactgtgcatcgggggaatgttcctgctgcggaatccatattatatcatggcaggcatcggaatcggcatactggatgcccttcccatctttgggaccggtacggtgcttataccatgggcggtccttaagctggccgtgggggactggaaacaggcgttgattctcacggccctttacctggtgtgctacttcgtgcgtcagattctggaggtgcgtatgatgggcggccaggtgggtctgtctcctcttgagacattggcgtccgtgtatgtggggctggaactgtttggattttttgggttcatactggggcctttggggctgctgctgattgaggatatggtggaggcatggacgaaagaggaagagatggagacatagggggatacaaggaatgatttgtctgccacagaagcgtcatatggcgattctgtggttgacaaagtcccaaaactgacgtaaaatcattcttacataaagagatgaccaattcatagaaatgacatggaaagggaacagtaagcgtgattgcacgtcacagagagaggaccgaaggtgagaggtccttacggttggcagatgctgaacccaccctggagtcctgcatgatgaatgcagcgtatgccggcgttaacggattatgagagaaccatgagggcggacagggccctgaggttaatgagggtggtaccgccgagtcattcggtcccttgtgcatagagcgcaggggacagggtggcttttttagtttcataatgttagatatgcaagggtcaatgtaaataacgaaaaggagaagaatcatggcagacaacaagaaaatggtagaggccatcacatccatggatgaggatttcgcccagtggtatacggatgtggtaaagaaggcggagctgtgcgattatgccagcgtcaagggatgcatggtgattaagccggccggctacgcaatctgggagaacatccagaaggagatggacagaaggtttaaggagacaggggtgcagaatgtctacatgcctatcttcatacccgagagcctgttggagaaggaaaaggaccatgtggagggatttgcccctgaggtggcgtgggtaacccatggaggactggaggaactgcaggagcgcatgtgcgtccggcctacttctgagacactgttctgcgatttttatgcaaaggacatccactcctaccgcgaccttcccagggtctataaccagtggtgttcggttgtgcgctgggagaagaccacgcgtcccttcctccgctccagggaattcctgtggcaggaaggtcatacagcccatgcatcagctgaggaagctgaggccaggacaatccagatgctgaacctgtacgctgacttctgcgaggaagtgctggccattcctgttatcaagggccagaagacggataaggaaaagtttgccggagcagaggcaacctacaccatcgaatccctgatgcacgacggaaaggccctgcagtcaggtaccagccataacttcggagacgggtttgcaaaggcatttgacatccagtttacggacaaggacaatacattaaagtatgtacaccagacttcctggggcgtgagcacccgtatcatcggcgccatcatcatggtgcacggcgatgacaacggcctggtgcttcctccgagaatcgctccggtccagattatggttgttccggtgcagcagcagaaggagggcgtgctggataaggcataccagctgaaggagcgtcttaccaaggcaggatttgccgtaaaggtggatgatacggacaagagtccgggctggaagtttgctgactgtgagatgcgcggcgtacccctccgcgtggagataggaccaaaggatatagagaagaaccaggccgtgctggtgcgcagggataaccatgagaagagctttgtatccctggatgagctggagtcaagagcaggcgaaatgctggataccatccatgactccatgctggagaaggcaagaaagcacagggatgcccacacctatacagcagccggatgggatgaatttgtggataccgtcaacaataagcccggctttgtaaaagccatgtggtgcggctgcctggagtgcgaggaaaaaatcaaggaagtggccggcgccacatccagatgcatcccctttgagcaggagaagctgtccgatacatgtgtctgctgcgggaaaccggcgaagaaaatggtttattggggcaaggcgtactagggttgtatataaaaatatatatggaaatggcagatgcaggattagacctgtatctgccatttatttactgggaaaagctgcagcttgctgtatttgcttcctcgttggctgcgttggccttcttgcggttcttcatgtaaaaataaagcggagccactacaaccattgcgccaagtccggccacaagctttggtaattccgtgttaatcaaaagccagatgctggcaatgactgccacggcaggaatcacgtttccaaaaggaaccctgaaatttgctttcatctctggatggtttttccgcagaaagatgacggccaggcatgtggggatgtactggctgaaccggctgaccacgctaatcattgccagttcggtaaagctgccgctcagggacaggagaatggccagcactccggttacaaccactgaaacatagggtacgttatgacggttccgctttgtaatggattccggtaaaagcccgtcctcggcaagggcctgggcacatcttggggtattaaaggaagaaccgatgttaattccggcaatggaaacaagggtaccgacggttactaaaagagcgcctttatttccaaggataattcccattgcatccgctaccggggtagaggtgccggatagattttctcccagcgttccaatacagataaactgtataaggaaataaacaattgaaacaacggacatggataaaatcaatgctttcggcacatttttggcaggattctccatgtcccccgctgcaagacctgtattttcaaatcctgtaaaagcatagaacacagtgataatggttgcggagacccctgcggagccaaggccggccgggaacagcggcgtaaaattagagcctttgatgaagaaaatacccactgtgacgcagagaacaaggggaaccagtttggctactgtggatatattgttcaggtaggccatgatattaattccgaacagattgatgatactcaggactgcaatgatgctgacagcggtcatcttctggacagcgggatttgcaaacaatgggaacactgctgaaagcgcagtggaaaatccaacggccatggttgcccatgcaatgatgcttacaatccatttcataatccccacttcataaccggcaaaggagccaaaggttttctgggcatacagataagggccgccggaacgctcgaacatgcttccgcattcagcaaaacacagtgctatggacatcaccaggacaagaacaaaagcataggcaaggagactcccggctcccattgttttataggcatttcccggcagcaggaagatgccgcttccgattaccatattgattccgtagaggatgactgtccccagactccattttttttctttcatgatttatttcctccttcgcataaacggtctaaaacgtattgggtgagtacggctacgccggcggctatacatgtttcatcaaaaatgtttgaggcgttatgaaggcccagacggctcccggggttatcattggcagtacccaggaaaaactgtgcgcctttgctgtattccaaaaagactgagaaatcgtcggagccagggcttggaaattcaaattccactaccttgtcttcaccgagcactgtgtgggccgcatggatgatatcgtccaccacctccccgtcattgtacagcggcggcaggcttcccattatttccacttctccttccgcccgcatgccctcgcagacagaatgggtaatacggcgtatggcctcgatattttgttccctgcattccggataaaaggtccgaagtgttcccagtatggttacctggtccggtatggcgttggaagcctgtccgccgtgaatgctgccaaatgtcaggacagtgggttttacggcctgattttccctggttatgattgcctggagctgtgtcagcaggaatgccgctgtcattatcgggtccacgcagcggtagggatgggcgccgtgaccgccctttccgcggattgttattttcagatgttccacgccagcctccatggggccctttctcaggcagatgcttccggccggtgtgtcgggatgggtatggagccctaccacaatatcatttgggggtgtcaggtccatcagtcctgcctttatcatggcttgtgcgccgtcgcatggttcttctgcgggctggaatacgattctgacattgccggcaaggctgtcttttctttcctgcaaaagtttggcgcagtacagcgctatgattgcgtggatgtcatgaccgcaggcatggctgattccatccatttccgaggcaaaggaaagaccggtagcttcctggataggcagcgcatctatatcgtggcggatacagattgttttgccgggccgctcaccacggataattgcggaaacgccggtgggcatttggagcggttccagttcaatgccggaattcagcagctctttctttaagaactctgttgtgtgaaattcctgatagctgagttccggattctgatgaagcagacgtctctgtgcaatcatggtttcttccagctttttaatttcgtcgattagttccattttatcctccttaaaacgctctttgttacaacttgaactctttagcaaaagtatactgttatcgtcaggtcaagtctattttttctcatttttcttacaaaaaagcaggggttgccagtaaatgtcctttcggaccactgacaacccctgctcaaatccgccggattaccgtttcagaaaatacaccagctttggcctgcccattctgccgtagctgttctgcacatccacctgtccctccttttgcatgtactggagatagcggtacaaggttttctttttgatacccgtgatttcctcaagctcttcaatctctttgtattcttttaattccctcattgcatcttccagttttttcagcgttactgacccaattcccttttccgtattatcgtagtactggcttttctcagcatagcttaaatggactttgattctggcaatcaggtcaacggccttaatgggtttcagggcgtagtcgtcagcccctgcctccatgaatctttccgccacgaattcccgttcttcaatggtcaggacaataatgggaagatggggaagtagtttccttatggtttttaccgccgtgatgccgtccatatccggcatatggtaatccacaatgacaagatcgatggcggatgtccggaggaatttttgggcctgcacggaattttcggcaagcagaggacgccatttctgaaacttgcaaatctgttccatggtatagagaatatctttgttatcatcccatatcagtattgttttcgccatgcaaagcagcctccttcatccatatttcaaagttggtgtactgtccttctccgctctgaatctttatgtcccctccatgattttcaattacctgttttacaaaatcaagaccaattccggtggaaccggctgccgaatatcccttttgccagattttctcctggattgcttccggtattccgtttccattatcccaaatacggataatgacggtcccctgtaattccctgaccgaaatatcaatcaggccgtccggtttttcctcgacagcccggtatgcattctggatgatgttaatcactgcccgggaaaaacggattcggttaacctgaagcagggcgcttttggcatggttccggtatttgataatatttcccggtatgccggcctgagcctgggccagtatggtgcggaacagctcgtctgtctggcatagctccctgtgttcttcatagagaatatctgaaatcatcccgctcatcccttcggcggatgcactgattcttcccagatattcccgtatctgatggtcggattccatcatttccgagagactaatcaggccctgcatggcggtgagcggagattttaaatcatgcaccaggctctggacctcgctggcgcttctgagtttcagtgcgtcaatctgggcctgatacagctgttccgtcatctgtttgttctgttccgtcattgtttttaaacggtgctctttataaagaagccgtatttggataagcagtgcaaacaaaaaggaacagcccagggcggcggcataaaagctgagcgtccatccgtctccgtgtctaacagcggtttcttttatcagggacgacagatttccgcgtccaaagccgtatttgctgataacaggaatttcatccagccattggaaacagagctgcatggatatcagcacaaagattttattggagagagggatggaaaataaatttaggtacgtaagcgcgaacacagacagaatcatgatgtgcgctgtcagtccgaaatcgaaccggattccgtggatgaagtaaatgcccctgtaaacaagaaacagcaccaggtaggtaagcagaaaattaaaaattaagaaccgtttcccgcggtatatcatgcggatggattcactcatcagaaaagcccccatatattggggaatcgccctgatgcaattcatcagcaccatctgcgctgcggatatcatgagataatatgtatttcctgttttcacataaacatccaatgcgctttcgattgagaagcttgtggttttcaggattcccggcagcgcaatgccaagggcagccagacacaggccctggagcagtttggttttgtcatattctgtttgcaggcttatgttaacggtcttgcagttcatccgcagttcctccgctggttcgtaccgcatccatttcatagaatgttgtctgatgatacgttaatacaattatagcatttcgggaatggaaaacaagccgttttccctgtacaaaacaatcacgcggcataggcagcggcccgtaattatagttttgaaacagtataaggagaaatggaccgtttaggggtatgcagttaaaatatctctggaaaaaggccggaagaactgataaaataagaccgtggcaatgtaaatcataaaatatttaaagtatgaggaagcagacagacatggaaatcagaattcctgctccggcagaggagattataaatagactgtacgaacatggatacgaggcgtatgtggtgggcggatgcgtcagggatatgcttttgggcagggagccgggggactgggatatcaccaccagcgccctgccccggcaggtaaaggaggtattccggcgcaccgtggataccggcatacagcacggaaccgtgaccgtgatgatgggaaaggaagggtatgaggtaacgacttaccgcgttgacggggagtactctgacggacgccatcctgacagtgtggagtttacgccggatttggcggaggatttaaagcgccgggattttaccatcaatgccatggcctataacagccgcaggggatttgtggatgaattcggcggtgcggatgacctggaaaagggcgttatccggtgcgtaggtgaaccgatggaccgctttacggaggatgccctgagaatactgcgggccatccgtttttctgcccagctgggtttttccatagaagaacacacctttgaagctatcaaggtaattgcgcctaatatggtccatgtgagcaaggaacggatacaggtggagctgaccaagcttttattgagttcccatccggattatatctcgctggtgtatgagactggaatcagtccctttgtgtcagagggatttcacagggccggtgtcatggaatcaggggattgggcggtgccgcctgttccgtccggggttccggcggtaaagcatatgcggtgggcagcctttctgagggagtgcagcgcttcccaggcagcgggtatattgaaggatttaaagctggacaatgataccatctgcaaggtgagaactttggtggagtggcaggggaagagggtaggctataaggaggttatggaagatgaagggggagaatcaggaaaaaaatcatccggggacgcgcctgtaaaaccatccaaggcattaatccgctgggccatgagccagatggagccggagctgtttgatgatttgctcactcttaaaatatgcctttctgaggcagaatccaatgacagggaagtggaatggctgcgccaggtccgggaattgacagaggaaatccgaagggacggggactgcatcagccttaagaccctggctgtgtccggccatgacatcatggaggcaggggtgaagccgggcagggaggtgggcagtacgctgtcacggtttttggatatggtactggaggaaccgaagaggaatacgaaggagtatcttctttcccttttagagtgagcaggcggagagatacgtatcagggaaggagcgcctgctccttccccttcttgtattcccgcatcatttcgcatacagccatcagcaggatggcatcctggtgacgtccatggcgccgtatatttatattacctttcattgctgcgggaaatgtataaaaagaatagcacggtaaaaaatacaaagaagaatccaggcccatcttgcaacatcttcaattatccgatataataaactttggggttcgcgcatgtcgcgtgagaatgaaaatcaatataatggggaatacatattgtacgggcatttcccctaaaaacaaggaggatttaaaatgaacgtaatcagcacagaaaaagcaccaggcgcaatcggaccatactcccagggatttgaggttaatggagtaatctacacgtccggtcagataccggtaaatccggcagacggcagcgttgcagaggacattgcaggacaggctgagcagagctgcaagaacgtaggcgccatcctggaagcagcaggcagcggctttgacaaggtatttaagaccacctgcttcctggcagacatgggcgattttgctacatttaacgaagtatatgccaagtatttcacttccaaaccagccagaagctgtgtggcagttaagacccttccaaagggcgttctgtgtgaaatcgaggcaattgctgttaaataaggattgacctgacatacgcaataaaagccgcaaatctctgcattttgccgggaagagcggcttttttgaccccgtcggcgctccgtaagagaaggaagagtggaatggataaaaaagcgattctgaaaaaagcggttaaggtacttctggtattgggactggcaggttgtctggtcctgttcctcgttaacctgtatatcatcaggaaggaaaagccgaatatcatcagtgcagatgatgcggcagcccttggtgatgtggactgcatcatggtgctgggctgcagcgtaaggcctgacggcacgccgtcaggcatgctccgggacaggctggataagggaatccagctgtacggggatggtgtatcagaccgccttctcatgagcggagaccatgggcgcaagaattatgacgaggtaaaccggatgaagcagtacgccattgacgagggcgttccttcaggggacatctttatggaccacgcaggtttttccacctatgagagcatgtaccgggccagggatattttccaggtcaagaaaatcatcatagtcacgcagcgctatcacatgtaccgcgctctttatgtggcgcaggccatgggtatggaggcatacggcgtggaatcagagccaaggcagtatggcggtcagaagatgcgggatttgcgggagctgctggccaggcccaaggatttgctctacacgatagtgatgcccaagcccacctatctgggcgacgccataccggtcagcggggacggtaatgttaccaatgataaggaagaaaaccgggataagaataggtctggccaggagtaggaaatatcctgccagaagccagatacatccagaggacatgaaaatgcccctgaaaacagcttatgggtatgaatcagctgttttcaggggtattttatataaaaaggaaaataaggaggctaaagtttgacaaaatagctggcatccttgccgcagaccggacagatgaagtcagggggcaatgtctcggattccagaatgtatccgcatacggtacagcgccatccggtcaccttatcggtgtctgcctgataggaaggtgcctttggcggagtggttccgtttttcttcagatggtaattggaataggtgagggctggtgtctgggaatccaggacttctgcttccactacctcgcccactataagcatatgggttcccacgtccatggaggatacaacgcggcaggtgaaccgtgcacagactccctcagtgggatatgggctatacagactgtcccgtccctgtgcaataccgtcaaatttctttacatccttgccgcactggaaaccaaagcgtttaatcaggtccatctccacatcgtctgaaagcacgaccgcggaaaaagtgccggatgtctcaatcagccggaaggtatagttttccttgttgagagcaatggataccctggcgggagatgaggtgacctgggtcagtgtgttgatgacgcagccgctttccttgccgtctgcgctggtggaaatgatgtaaacgccgtaacttaatttgaaaaatgcttttgaatccataaaatgtacccctcctgtgtttcatttgccttttcggctatagtttgattttaccacgtataattgataatatgtaagatatttgtattgtaccatagaaattccataaaatcaataataattactattattataaaaaatattgtacacagatagtttcttatttggagcctatctgctacaatcatagaaaagcagtatgagaagtatctaatacagtatgataaatctagtcagcagtatgaggaatatggataacagcatgtatgaaaggcaggcggtgaatcggtatgcttacacgggataagattgtcattatgaattttacaggagcctatgaaaaacagtcattttacaggggattgaacgctgtgtggctggagcttaaagatttaaagggcaccaattgttactgtgaccaggaggcggaagcagccatcagggagagaatccgctttatggagccctccggaatccatttcctggactccgggaattaccattatgtgagtaaaatctggctggataagatagaaggggaatttgaactgctggtatttgaccaccatacggacatgcagatgcctatgtttggagatatcctgtcatgcggcgggtggattcagtcagctctggatacgaatccgggattgaaaacggtctatctggcaggaccgccatgtatggaggaggaaactgacggggaacgggtcattggaatcagggaagaggaattgaagataccggggtgcatcagcagtcatctgaagaactccggactccccctgtatatatcactggataaggacatcctgggccaatcctgggctgtcacaaattgggaccagggagaggtccggctgggggatgtgctggcatgcataaaagaggctgcgtcctgccgcagtataataggggtggatgtatgcggggaagacccggagaacttggaacatgagggaagcagggctattggcattaatcagaatacgaacagagatattgtttgtaaattattggaagtctgtgatatactgtctctatgataagggcggcaggaccggatgatgccgaaccaacatggtaatgaaacagtgtgacgatgaaacagtgcggcaatgaaacagtgcggtaatgaaaccgcgcgtcatagggtataacagcaatcaaggaggaacgtcgatgaggaagattttcaggcagtatatgttacaggccataatctgtatgattatcatgtgtgtattgtttttctggcttcgcggcatacctctgatgggactgccggatgcggatgaaatatccagtgtggaaattctggacagagatgcggggcaggagccccgtttgtttcagacccgggacaaaatagatttggcttcaaagatacctggttttctgaactatgaactgggaaccccggacaaaggggaagcggtaattacggttacatatcataaaaaggatggcagtactgtggaaatctcggccaatgagtctactgtgtactgacacgggagggcatataagattaagggggaaaatggccggacattcatcaatgtaacaaggggaatattttttccggatatataggatgagatgaggacagctatgaagacgcagtcataaagagatgaggtaagtacacatgaaacgaggtaaatacacatgaagccagtgataggaatcataccattatatgacgaggataaggacagcatatggatggtgccgggatatatggaaggaatccgccgggcggggggaatccccatgatactgccgcttgtatgtggcgaggcggatttacgccagataaacagtatgtgcagcgggtatctgtttacaggtggacatgacgtggacccatccctatacggggaggaaaagaccgctctgtgcggacctgcctgtatggaacgggacaggctggaacaaaccgtgttttgcatggcatgggaggaccgcaaggcggtgcttggaatctgccggggcctgcagctgataaatgttcttatgggaggcaccctgtttcaggacctgcagtcccaatttcagggtacctgcagcgtcgggcaccacatggaaccgccctacagccgggcctgccatcaggtggaactgacggctgacggaccgctatgtaagctcttgggaaagagtaccatgggagtgaacagttaccaccaccagggaatcaggaaactggctcccgggcttaaggccatggctgtggcagaggacggactggtggaaggagtatatgcgcctgacagggaatacatacaggctgtacagtggcatcctgagttcatgccgccggaggacgcagatgcaggaaaaatattccaatcattcatagagggatgtaagagacatgcatagggatttgactacaggttccatcacgggaaccatgctgcggttcgcacttcccatgatagcggggaaccttctgcagcagttttataatattgcagatacactgattgtgggccggtatctgggagtgcaggcattggcagcagttggcgctgcctatgcgctgatgtcattccttacttccattctcctgggtctgtgtatgggaagcggagctgtattctccctgcgctttggagagaagaacgagaggatgcttaaatccagtatgtttgtatcgttcgtgcttgtggcggcagtggccctgatactgaatacagctgtattcctgttcatagacccaatcatgcgcctgttatgtgtacctgcggaaatctatgggctcatgagagaatatctgtgggttattttctttggtatcagcgctgtattcttgtacaattattttgcgtgtcttcttagggcggtgggaaattccttcataccgctggtatttcttggcatatcagccctcctgaatgtgggactggatttggtgtttgttctggtctttcaatggggtgtggccggcgctggtgcggcgactgttatttcccagtttgtgtcaggcattggaatctgcctgtatacatttttaaaaatgccggaattcaggataaacagaagccatatgaaaatggaccggaaggtgctggcggaaatatccggtttctcatttctgacctgcgtccagcagtcagtgatgaattttggtatattgatggtccagggattggtcaacagctttggcgcggcagtcatggcggcgtttgccgcagcggtgaaaatagactcctttgcttatatgccggtacaggactttggaaatgcattttccactttcatagcccagaactatggagctggcaggcatgaccgggtggaaaagggaattaaaagcgctgtcgctgcttccgccttgttttgtctggtgatatcattcattgtgtgtgtgtttgcaagggagcttatgcttatttttgtacagccacaggaaaccgaaatattggcagtgggggtgcagtatcttcggattgaggggacattttactgcggtatcggctgtctgttcctgctgtatggcctgtaccgtgctgtgagaaggccggagatgtccgtggttctgacggttatatcgctgggaaccagggtagtccttgcctacgtcctgtctgcggttccttctatcggtgttgcaggtatatgggcgtcagtgcccattgggtggtttctggcggattgtaccgggtttgtgtattattggatgaagcggaaggtgatattgagctaaggggaagctaaagccaaacagggaccaaacgtgagccaaacgtgaaaattttcttgacttgaagttaactccagatgataagatactggaagaaagcttaatgagaggagatttacatatgagtaaaaaagtattggttttatcagcaagtccaaggaagggcggaaattcagacaccctctgtgatgcgtttatccggggagcacaggaagccgggaaccaggcggaaaagatttttctggcgggtaagagtatcggatattgcaaagggtgcggtgtctgtaacacaactcataagtgtgtccaaaaggatgatatggcagaggtgctggataaaatggttgaggcagatgtcatcgtgctggccacccctgtttatttttacaccatggacgcacagatgaagacattgattgaccgtacagtgcccagatatacggaaatccagaataaagatttttacttcataatggctgccgcggatacggaacagaagatgattgagcgcaccatagagggattccggggatttacgcaggactgtctgacaggagccagggaaaagggaatcatttatggaacaggtgcatggcaggcgggagagattaaagggtccccggccatgggtcaggcatatgagatgggaagaaatgtgtagttaaaataaaatgcatgatggcctcagggtgcgtcatgcattttttgatgcttgtctggcggttgtaaatgcagggattccttaaccagatatgttgttttaggaaagataaacagtggattaaagtggttatgcggtcgggaatgatgagtactagatgaatgtaattctcagaaaaaattcgacgagtttagtccggacgaaataaaatatttggaatgtatggatatatgtgacttatagtccgttgataaataagtcacactccgctacgcttacctacaagaggtgagtgcgatggagttttctggtgatataaaaatggaagttggaaacagaatacgccaattgagaaaggaacgattattaagtcaagaggcattggcattcaaggcaggtctggaccggacctatattgcatccgtagaaaatggaaaacggaatttatcaattatgagtcttgaaaagattacaatggcattgggctgttccatggctgaattttttgagatatttgagtaaatattctatactgaggatgcaatatgaatggttgtttagaattatatagatagtcttttagtaactacatgataaaaaatcggagggcttcccatgagccagatttggtacgctgctttcagcgaagattttgtagagcaggcacagcagatattcaaaaaattggataaggacgtaattgtcacggtatgggacccggagctggttccggaaatgctgaggcgcggggtgagcgtcatattggggcggggggccacggctttgcgaatccgcaaggtagtggacctgccggtggtggaaattcccattccgtttgaggatatggcagacaccctgattgaggccagccattacggcagaaacatcggtgttattggctataacaatcttctcagcggtctggaacgcttaaaccctatcctgaatgtaaatatacggcagatatttgccgtggatgcagatgatacctatcatcagatccagaagcttaaagatgaaggggtggacgtgattgtgggcggccttatccagacccgttatgcaagggaattagggctgccggcagtccgcattgagctgacggacaagtccctgtcctatgcgtgccaggaggcagagaaactgattgccacggtcaaggcggcgaccagaaaggcggaggagcttaagaccatactgaataccaccaatgagaagtatatagcagttgacataaaaggaaatattacctggatgaaccgggtggccaaaccctatctgcccaatccgggcggccgcgtttatgacatgcccataacggaggtatttcctgcctttgaggcggtctgtgacgtactggcgaccggggaggaaatcatacaggagacaggctccatcaatggggctgatattctctatgacatgattcccctgacatataaaaacgaggagatactgggcgcggtcatcaccttcaacgatgcggggaccattacaagaggggaacataaaatcagggataaaggcataaagggattccaggcaacctactcctttaaggacatatgcggaagcagccagcagatgaatcagtgcatccagcatgcaaagcggtacgcccacacggacctgaccgtacttttgctgggggagacaggttccggcaaggagatgtttgcccagagcatgcataatgccagcagccggaggaaagggccctttgtggctgtaaactgtgcagcccttccggaaggaattctggagagtgagctttttggatatgatgacggcgcatttaccggcgccaggagaagtggaaaaatgggactttttgagctggcccacaatggaaccatttttctggatgagataggggaaatgcccatgtcccttcagagcagactgctgcgtgttctgcaggaacgtaaggttatgcgcctgggcggcgaccgggtctttcccgtgaacatcaggatatttgcagccaccaacaaaaatctcattgagctggtgaaggagcataaattccgggaggatttgttctaccgtctgaacgtgctgaccctgaaaatcccatcgctgagggaacgggtggaggacattcctggcctggctaatctgtttctcaaagaaggcgggggaaaatgctgccttactccggctgcacagaaggtgcttacctcctacggatggccgggaaatgcccggcagctgagacattttatggagaaggtccgtatcatatgcgattcctccgttatatcaggggaggctgccagctatgtgatagagaattatgaaccgccttgcgggatggagcagattggagactggactgccagccaggaaggccatggaaatgggaatgacaaggtatatggcggcagtggggatggcggccgggagagcctgagtcaggagagtctaaagcggatggacctgagccgggagagccttagtcaggagataacagaacagcttctgatgcaggcaattgaacaggcaggtggcaataaaacgaaagcagcccggattcttggtgtacacaggagtacggtttggaggtatatcaaaaaatatggagtaaagtgatagagtatgattttgtatattatgtgcagtatgaaatatagcggtgagcaccggatacagtgccgcacatgatatcccatagggtgtcgcatgagacgtcgcataaaatgtcgcaagagatgttgcgttaaatgatacgccacacttttgattttgaaatgcgacacatgacatgaaacagccaaggtaagaatcaattccaaccggaataaatttgttttttctaccttttttcgaatctgaaaacccaaaaaaacagctatattttgcagatattaacataaatatctctgaatatagctgttttttctcgtattcctgtaccaaacaagaaaaatggcacaaatattgcttgataatactgtataaccatgtactaggagggaatgaaatggtagatttgagaagtgacaccatcagtatgccaaccagagcaatgttggagaccatactggaagcaaaacttggggatgacggaagaacggattccagaggaaggggtgaggacctggcggtcaatgagctggaggacctggcggcagagatgacaggaaaagaggccgcggtggtgttcccgtcaggaacacagggcaatacatctgccattcttgcatactgcaagccgggacagaaggtgatggtagatgagatgcagcatatctacttaagtgaaaaggtggtatttgacccatccatcgggcagcttgagccggttacctataaattggaccaggacaatctgccggaccttgacgatatgcgccgcatactggagagccaggaaattgccctgctgtgtattgagaatacccacaacttttcgggcggtacctgtgtcccgctggagcggatgaaggcgattcgtgaactggcccaggagtttggcgtgcctgtccatatggatggcgccaggatgtttaacgcagtggtggccctgggtgtggaggcacgggaaatgtgcaagtatgtggattccgtgatgttctgcatttcaaagggtctgggagcgcctatcggatcgctggtatgctgttcagaggaattttccaggaaggtcagggataagaggaagcttttaggcggagccatgaggcaggcaggtgtgattgcagcacctggaacgtatgcccttaagcacaacattgagcgcctggcggaggataatgccaatgcggcctatgcagcagagcagttaaaggatttaaagaacacaaaggtatacggaaaggttatgagcaatatcattgttctggatgccaatggactgggacttacgccgggtgaatactgcagcagggcggctgaaaaggggttattgattaagccggtgctgaaggataaggtaagacttgtattttacaaggatatttcgagggaggacacggagaaagcggtatcaattatacgtgaactggattctttacgataaagggggatttgacatatgaagattgctggtaaaaaggtaggtttatccacgcagatatttgcagccatgttgttgggagcgattctgggaatcgttatcggggaaccaatgaccaaagttgggtttattggaaccatctggctgaattgtattaagatgattgttgtgccaatggtactggttaccattgtaacgggagttgtttcacagaaggatatgaaaacactgggaagaatcagcttccgtatcatggcatattatattatcaccacactggttgcctgtgccatcggcatcctggttacatccattgtaaagcctggcaccatagccaattttacagggctggcgtccaaagaggtaacaggcagcgcggacataacggtagctgatttctttacaggcatgttctcatccaatatcatccagacctttgctgacggcaatattcttcagacggttgtcattgcaatcctgctgggcgtggcgattttaagaatgaagaatccggagcacaaggaaaaggcaatcaagggcatgaacgtgctcaacgacatggtattttcactgattaacatgattatgctggtgtccccaatcggtgtattcttcctgatgggagattcttttggaaagtacggagccggtatctttacaagtatggcgacccttgtaggaacctattatctggcctgcctggtacatgtggtactggtttactgtactgttatctgggtaactgcgggaatcaatccgcttaagttcttaaaggacagcgcggaactttgggtgtataccatctccacctgctccagtgtggcagcaattccgattaacatcaaggtggcaaaggaaaaattcaatgttccggaaaccatttccggtttcaccgtgcctctgggctcacagatgaactatgacggcagcgttatcctgtacggctgtgtcatcctgtttatcagccagaccattggtgtcccggttaccctgggaaccatggtgaaaatcatactgatgtctgccattctttccaccggcggcggcggtattccgggaagcggtattgtaaaacttctggtcatggttactgcctttggtctgcctacagagattgtaggtatcatcgctgcattctaccgtctgtttgacatgggaaccacaaccaacaactgcctgggcgaccttgcaggtactgtgtttgtgtccaagctggaggataaggcagctgccagagcgaaatcagcataggcggattcaatctaagaaaatgaaaaagtcccgggttctgcatcatgcggagtccgggacttttccggttggttttatggctgcagctcaaatatgatgccgttcttcggttccatattcggtcccgattatgatttttccgcagatatcgcgaaataggcctgtctccaatatgccggtcatggccttgagacggtgggctgccgcgggatagttcatgtctttgcttcctgtcaggtccagaatatgattgccgttatctgtgacaaatatatttccgtcttttaacctcagctttggtataaatcctgctttctttacctgctcctccacataaggcactgcaaaggaaggaacttccacaggaagcacacacccgcccagggattttacaagtttgctccggtccataatccatatgacctgccgggccctgcatgcaatgattttctcccggaacagagcgccgcccccgcccttaatggaataaaaatccgggtcaatggcatccacaccgtcgatggccaggtgtatggtttgtgcatccctcagggatatgaggggaatacccagatgctgggccaatgattccgttccaagagaggtggctgccgcatggatgttcaggccgccgcggattcgttcagacaaattttgaatgaggtaatatacggttgaaccggttccaaggcccagtaccatattatcggttacttccatggccgcccgccaggcagccgcttttttctgctcttctgtactgtacatattctctcctctgtgccggccgtgcctcgccgatgtgccgccttccgccgatgtgccgctttcttccgatgttccgccttccgccgatgtgccgccttccgccgatgtgccgctttccaccgatgtgccgccttccgccgatatcccgccttcttcctgcagacctcctacagccagctatgcccatgctgctccagcagccggtccgcttcggccggtccatgggagcctggtttataaggatacaccggaagtttatttcctgcatagagttccttcagacagctgatgtaattccagctcagctctatctggtcccactgggagaaccaggagcgctcccccttcatgcaggcagtgatgagacgttcataggcctcaggggtattgagctgatgaatcaggctgcaattctggcagaagtccattttggccgggatgatatcttctgagtcgccggggcgtttgatattaaactgcagataaacgccttccgtgggctgaatctttatgattagtatattaggctccacctccggataagggcggcggaaaatcacggccagttcaatttcgcgctttcctgtcttttttccggtccggatgtaaaacggagttccgttccagcgttcattgtcaataaaaaggcgcagggctccataggtttcggtctgtgaatccggttttacaaggggttcgtctttgtatccctcatactgccccaggaccagggtgttttctatggatgtaccgccggccggccgtaaacagcggaagacatccaactgggcgtcgtgcagccccttggggctgaattcctccggctgctccatagccatgatggacaaaatctggaacagatggttctgcaccatatccttcagggcaccgctggcgtcgtagtaaccgccccgggtttccacgcccatgtcctccagagcggaaatctgtacggattcaatatagcgggaattccatacatccgtaaaaatgggattggaaaagcggattgcctggatattacggaccatttcctttcccaggtaatggtcgatacggtaaatatgctccgggccaaagaatacttccagctctttgttaagggctgtggcagcagccaggttttcaccaaagggtttttccagtataaccttgccggaggcggagccgcggaccagcttaagcccctctgtgatggctttgaaaaagcggggcgccactgcaaaataaaagatgtgtgacaggatatcattttttctgtaatactcattcagtccctggtattgtcctaaatcagagaaatccatccggtaataatctattttttctgcaaaacagccgaatgtatgttcctcaaaggagagccgggtgaatttctccacccagtccctggcaatctgacggtaatggctgctgtcatagtcacggcgcccaatgatggtgatacggctgtcctgcggaagctttccagtgatatccatggtgtaaagggcaggcaggagcttgcggaaggtgaggtctccggttcctccgaatatggtgaggttagtgctgattttcatttgcccacctccattcgtggtggaatacgccttcgcggtcggttctctcataggtgtgggctccaaagcagtccctctgggcctgaatcagattggcgcctgctgcctttgcccggaattcatccaggtaggacactgcattgcagagggcgggaatgggaaggccgctcatgacgcctgtggaaacggcctgacgcagactgtcctggtgctcattgatgcgtgacaggaagaaacggtcgaatatcaggctttccggcttcggctcagcttcaaaggcatgggtgatgtcatttaagaaaacagcctgaatgatacatcctgcgcggaatatggaagcaatttttcccaggtccagattccagccgtactgtacggatgcatcctgcatcagtgagaagccctgggcatatgcaatgatttttcctgtatacagggcctggcggaccatggctgcaaatgacgccttgtcaggggacaggctgatggacggggaatgaataagcccggacgccttttctctctcatccagatggttggacatgattcgggctgtgcaggcggaggtaatcatagagatatccacgccctgtctcaaggcttctatgctggcccatcttccggttcccttttgcttggcgctgtctctgatgcggtcgatgagcgctccgccggccaggtcatcagcctcccggaaaataccggctgtaatgcctatcaggtaactgcgaagctccccgtcattccaggattgaaaggtatcggccatctcctgattggtaaagccgcctacatattttagcaggagataggattcagcaatcagctgcatgtctgcatattcaatgccgttgtggaccatttttacataatgccctgccccgtcagggccgatataggcgcagcagggttcgtccatggccctggcagcaatggcttccagtatgggacgaactgattggtaagccccggcatcaccgccgggcatgatggagggaccaaaccgggcgccttcctcaccgccggagatgccaactccaagataatgaatccctttgtccgccagcagggctgcccgccttctggtatcctcaaaaaaggaatttcctccgtccagaatcatatcccctttctcgagaaggggagtcagctgttctataacagcgtccaccggtttaccggcctgaatcatcagcataaccttccggggacgggaaagggcatctgtcagattggccaggtcataaaaaggaatcaggttctcatgggggtgttctttcattacctggtctgtgacggcggcgctgcggttataaccgcccaccttaaaaccgtggtcagccatattcagggcaaggcttctgcccataacggaaagtcctatgattccaatatcaagttttgtcatgctattacctcctatcaggtgaaaaacgggttaattggtgtgcggggaaagaacaatggaaacagcctccggcgcaggcacacgggaacatatttccatgagctgtcctgtttccgggttaatctgaaagctcacaaggccgccctgggtccggtttgcaaccagcaggtaccttccgtccggggtgagaaccatgtcgcggggatggacgcctccgcacccggtctgctggatttgctccagatgcccctggtgtatcctgaaaaccgttatgacttcggcaaagcgggtggatacatacaaaaagcgctggtccggtgagagacgaatggccgcggacgcaggagattccttatacactgcgtctgaagggaaaagcgggtaaatttgcataagcctcatggtaaagtccggaagagatatactgctgctgtctgccccggaggcagtagtttccgtcagtccatagacaaagacctgattgctcagctcgctgacaaggaatagctgcgtatggtccttgtcaaaaattccgtgtcgggggcctgtgcctgtgggaaaggccagttcagatacaagggcaaaatccatatggcggtcaaacaccatcactttatccagcagcaggcagggaaccatcatataatgactgtgaaacaaaatctgatggcatccggctttgggtgcaatgagaatttttttaaccggtttaaggtaccggcgggccggacatttttcgtgtccgtggaaattggcctcatgttttatctcatatatcagtatggcgccttcgtggtagttggccgtgtatatatatcgttcatcctgggcaacgtagcatgccggtgaggattcatcgaagtattcgccaaccagtggaacagaggcattctctttattatgggctgtatccagaagacatatcccggacctggcctccctttttaaaggagaggccagcatggcgtccttaagggaaagatacttacaatccggggcttcataatataattcagggtaagacattgccccattccttaaatcaatggtaaaacggtaaatgcccaggctgtcaggcgaggcataggtacccagaaatccggtgagggtgttgttcatggcagttcctttctgaataaactgtaatcaaataaatatcagttcctatctgtaattataaaagttacagtactatatgtcaagcggtatttgagaatagtttcaagagcatttttttgttgttaggatgcgccatatttacggattgatgcagtgggaggagcttggaatgaatggaagtaagaagattggcagtggtaaaactgataataataaagctgacggtaataaaacagataataatgaaaccaatggtaaatcagataaatcataacaaaacaggaaattccccatgtatgacatttataggaaatttcctgtttataaaaatcatttattcctgttttcgaagattcataaatccgctgtcagattctattttgcaggatagaatccgctgggagcctcggacagattaatcatgatattcttcatctgtgtatagtgctccagaatgaccttatgggtctcacggccgatgccggactctttgtagccgccgaatggtgagccttccggaatctgattgtatgtattcacccacatacgtcctgtctcaatgccccgggatacacggattgcacggtttaagtcacgggtccagacagcgccgcccaggccgtatgcattgtcgttggccatacggatgacctcgtcttcatccttaaacttaaggatacaggccaccgggccgaaaatctcttcctgggcaacacgcatgtcattggtcacgtcggccagcagggtaggacgcatgaagcagcccttagccagttcgccttccgttatacgctcgccgccgcaaatcaggcgggcgccttcctgcttgcctatttccacatagcttaaaatcttctccagctggcgttcattaatctggctgcccatctgggtttcagaatcccatgatacccctacctttacattattaaatgcctttactgcgtcctcaaggaacttgtcgtaaatatcctcatgtacgaatacacgggaacctgcgcagcatacctggccctgattgaacagaatgccaagctggaggccgtcaatggcctgctcccagttgcagtccgggaagaagatattggcggattttccgcccaattccagggtggcggggatgagacggtcggctgctgccagggctacctggcggcctacctcggtggagccggtaaatgccagcttgcggaatcctttgtggtcaagcatatactggccggattttgagccggaaccggtaatcacattgaatacgcccttgggaatgacatcctgtactaaacgggcaaattcaagaacggaaagggatgtgtcgctggatggtttaaatacagtacagcatcctgctgccaggacaggagccagtttccaggcagccatcaggaatgggaagttccagggaacaatctgacctacaacgccgattggttcacgtaaaatcagggaaaggaactgctcatccagtacattggcgctgccttcctcggccatgatgcagcctgcaaagtagcggaagtgctttgcgctcagcgggatgtcgatggccattgtctcacggatgggtttgccattgtccagggattccaccatagccaggtgttctgtgtttgcgtcgatgatatcggcgattttattcaggattgcagcacgttcgctggtgggaaccattttccatgtctcaaacgctttccaagcttccttaacagcatcatccacgtcatccttggtagcctgcgcgcactcggccagcttttcaccattggcagggcattttgtggtaaatacttcaccatcagaagcgtcccgccattggccccctatgaaaagctgatacctgttctgaagttctggtttgttcatgtaatacctccttgttttgtgttgttacactcctataaataagacttataaaagccttgcttccgtttacattaactaccatatcattttcacataaaaaatgcaatatttgttaaattgttttcataatagtttttattttaacaaattttcagtcattaaagattgaaataaaaggaaagtcacgctataatgaaagaaaaaaataaaaatcaaggaggaaaattaaaatggagcaaaaaagtccagataaagtatgttatcaatttatctgtcccaaatatcccaggtgcgcgagggcaagaggaaaggggtgctgcatcgaatacccggaggatgagacacagatggtacaggcgggggagtgcagtgctgaggatggctttccgttgtttgtgggggaggagtaagtatatctatgtttatgacagaatgaatcgggttcgttattttaaataaaagatgaatatggtaacatttgtcaaaaacatttaatttcagacaaagatatgttataatttgcactataatgggggaaggggggaacctatgcagtactatgcgcatatcagtgacgacaaggtacgcaagcagaccgtgaaggaacatctgacagggacagccaggctgtccggattgtttgcagaggcattccgatgcggagaatgggggtatggatgcggaatcctgcacgatatagggaaatattcccagggattcagaaagcgtctggagggcggttccatgatagaccatgccacggcaggggcccgggagatgatgcgtttgtatgccaggtccaatccgctggctgcttattgtaccgcttattgtatcagcggccatcattcgggcttgctggacgggggaaggaccggtgacacagcaggggaggccacgcttcagggaaggcttaagaagcagctggaggattacagcccatacaaagatgaaattgcgctgccggattttccagggctgcccctgagacagataggcaggggtggcttcagtctgtcattctttatcaggatgctgttttcatgccttgtggatgcagattatctggatacggaacatttcatgctgggacatgatgggggaaggggcggccatgatgatatggacgtacttctcagccgtctggagagccatgttgggccgtggctttccaatgatgatttggcgactgtaaacgggagaagaacggctatcctaaaggcatgcctgcaggctggcagcaagggacaggggctgtaccagctcaccgtacctaccggcggaggcaagacggtatcctcccttgcctttgccctgcgtcatgcagcggaacatggcctgagccggattatttatgtcattccgtatacgagcataatagaacaaaatgcccaggtgtttaaggaaatcctgggaaggaacaatgttctggaaaaccattgtaatgtaacatatgaagacaaagacagtgaaaaggaattgaaattggaacagatggcagcggagaactgggataaaccggtggtggtcactaccaatgtccgtttttttgaatcgctctatgcctgcaggacctccggatgccgtaagctgcataatatagccaacagtgtcatcatatttgatgaggcccagatgctgccggcaaaatatctgatgccctgccttcgggctatcagcgagcttatctgtaattatcactgtacggctgttatctgtacggccacccagccatctcttcagcccttctttccgccgaagatacaggaactgcaggcggtggagatatgcccggatgtaaaaggacagtatgacttttttaaaagaacaaagatacacctggcaggtcagatatcccaggaccacctggtgagccggctggaggggcatcagcaggtcctgtgtatcctgaacagcagaaagcgtgtgcagcgcatttacgaatccatacaaggagaggggacgtaccatttatccacactgatgtacccgaaacacagaaaggtgctgctgagagagatacggaaccgcctgttatcaggagagccgtgccggcttatttccaccagtctggtggaagcaggggtggattttgatttcccggccgtgtacagggagctggctggaattgacagtgtgattcaggctgccggaaggtgcaaccgggaaggaaggagaaagccggaggaatgcatgacggagatatttactctggaggaagaggaggatatccatataccccgggaactgaaactgcctatttcagttgcaggacagattgtacataaatacggggatatatcatcacctgaggccataggcgaatactttaccagactgtaccggtataagggggagggattggatgcaaaggatgtggtggagcagtttgaacagggaagccgttcttttatgtttccatttgcatcggtggcatccgggttccgtctgattgagagcaataccaggaccattttgattgatatagaaccggaggcagtgcagattgccatgcaaatccgaaggggagagcatagcagacagcttatcaggcaggcgggacagtactgtgtaaatgtctatgaaaatgattttgaggcgctgaacggagcaggccgtcttgaacagatagaccaggaattttatgtcctgaggaataaggaacagtatacagccgagaaagggcttgtaattgacgtaagccgcggtgatgccgtcatgttctgagttagagtcccttataggaaaaggcgtatgccggagaggagtgaagtgatgagtcgaggagtacgggtccggatgtggggagattatgcccttttcagccgccctgagatgaaagtggaacggtgcagctatgatgtgatgacgccttccgcggccagggggatgctggaggcggtctactggcatccggggatgcgttgggtggttgacaaaatctatgtgagaaaaccgattcagtttaccagcatccgcaggaatgaggtaaagagcaaggtattggcaggaaacgtgctgtccgccataaatgggggaggaaaaccgctgtacataagcagcagggaggaaatcgtacagagggccgccattcttctgcgggatgtggaatatgtggttgaggcccattttgagatgacccctaaggcaactcccggggataacgagggcaagtttaaagatatcatcatgcgccgtctgcggcggggagagtgttatcacaggccgtattttggctgccgggagttccctgcccggtttgctctctatgaagaggaggatgtggatactgcatatgagggaacggaaaaggatttggggtatatgctgtatgattttgattattcagatacagaggacataaaacccatgtttttcagggctgttatgaaggatggtgttctggatgtgaggaattgtgaggtggtgcgatgattctccaggcgcttgttgaatattatgaagctcttgaacagaaggggaagataaccagtccgggctggtgcagggccaaggctgcgtacggcctggatatttcaaggcagggggagcttaaggctgtcattccccttaagcaggagcagcagagaggtaaaaagacagtcatggtaccgcaaaaccttacggtacctcagatggtttcccgttcttccggcgtatcagccaatttcctgtgcgaccattccggttatatgctgggaatcgataataaggggaagccggagcggtccagggaatgttttgagtgtgccagaaagcggcatcaggacatccttgggaatatcagcagtcctgcagccgtggcggtgtgccgtttttttgactgctgggcgccggaccaggcagcagataatccatgtcttatgccggaactggaggagataatatctggatgtaatctggtgttcctggtggagggagagtacgcccatgaggacccggatataagacaggcatgggaagcgtacagcagacagtccggtaccggacctgtgggtgtctgccttgtaacggggcgcagggaggaaatcgccaggattcacggcaccatcaaaggcgtacagggagcccagtccagcggggctgcgctggtttcctttaatgcgccggcctttgaatcctacggaaaggagcagagctttaatgcaccggtgggaacatacgcggcctacgcctataccacggcgctcaattatctccttgcagaccggacgcacgggacaaccattggtgatacggctgtggtctactggtccgaggacggtgacgacctataccagaatatatttgcatctgtgtcggagccttccatggaaaaccaggaaattgtggatggggtattcaagaatctggcagagggaaaagcggttgtggcccaggatgtcctggactgtctggatatgggcaggaaattctatatattaggtctggcgcccaatgcagccaggcttgcagtgcgttttttctatcaggacagctttggaaatatattaaagcatatcaaagaacactatgacaggatggcgattgtacggcccgcagccgatgccttggagtacctggggatgtggcgtatgctgcaggagactgtcaataaaaagtccagggacaaaaagccggttcccagtatgtctggggctgtgtaccgggcaatcatatccggcagcccttatccggcatccctgtatcaggccgtgcttggaagaatacgggcagagcaggatgacggggacagccggatttataagataaccaggggcagggctgccattatcaaggcatatctgctgaaaaatggaaataacagggaggaaataaccatggcgctgaatgaagacagtaacaatactgcgtatatcctgggaagggagtttgctgttctggaggcaatccaggaggatgccaatccagggattaacgccaccataaaggacaagtattttaactctgcatgtgcaactccggcagcaatctttcccattttatttaaattgaaaaacagtcatataaagaagatgaacaatggggcaaaggaggtatattacgaaaaaatcctggttgatttacagggaaggctgaatgtcgcagagggacagaaggcagcctgcccaaagcggcttaccctggaggagcagggaatgttcatattgggatattatcaccagactcagaagcgatatgagaagaagataaaggaggaggcttaaaatggcagaggtaattaagaacaggtatgaattcgtggttttatttgatgtggagaacgggaatccaaatggcgacccggatgcaggcaatctgccgaggattgacccggagagcggatacggcattgtgacggatgtatgcctgaaacgtaagataagaaattacgttgaaaccctgaaggaagaccagcctgggtataagatatacatccgggaggatgtaccgttaaacagaagcgataataccgcgtacatagagctgggaacagatgaaaagggaatcaaggaactgaaaaagaaagaccctctggtagaccagaaaatccgggatttcatgtgccgaaacttttttgatatccgtacctttggcgcggtcatgaccacctttgtgaaagctgcgttaaactgcggccaggtgcggggacctgttcagctgggctttgccagaagcattgacccaattgtaagccaggaagtaacgattacccgtgtagccattaccacggaaaaagatgcggaaaataagagcacagagatgggaagaaagaatattgttccctatgccctgtaccgtgcagaggggtacatatcagccaatctggccagaaaatccacaggcttttcagaggaggatttggaacttttgtgggatgccatcatcaatatgtttgaaattgaccattctgcggccaggggaaagatggcggtccgcaggctcattgtgtttaaacacagcaaggaactgggagactgccctgcatataaactctttgatgctgtggaagtgaaaaggaatgaggatgtggagtatcccagaagatatggggattatacggtcgcagtccatatggagcagattccggaaacggttgacgtctcggagaaaatataatggatttcagggaagacgatttcctcatgctatccggtatccagcatttttccttttgcaggcgccagtgggcccttatacatattgaacagcagtggaaagaaaatgagcataccatagaaggagaactgctccacaaaaaggcccatgacccatatctgacagaaaagcgcggcgatgtgattataagcagggcattgcctgtgtattccaggattatgggcgtcagcggtgagtgtgatattgtggagtttcacagaacagaggatggtatcaggctccatgggcacaggggaacgttccgcatatttcctgtggaatataaaaaggggagtccgaaggaatccgaggcggatatactgcagctgacagcccaggccatgtgtctggaggaaatgatgtcagccaggatagaggctggtgcattgtattatggagagattcaccgaaggacggtggtggagataacagatgagctgcgaaaacaggtacgtgatatatttcaggaaatgcatgaactttatgacaagggatatacgccaaaggtcagatggtcaaagagctgcagcgcctgttccatgaaagatatatgtctgccgaaactgggaaaggcattatccgtcagggactatatccgcgggaagatggaggaggatgtatgaagaagttattaaacacgctgtatgttacatctcctgatagttatctgtcgatggatggggaaaatgtggtgatttatgataaagagacggagctggggaggattcctcttcataacctggaaggaattgtatcctttgggtacaggggaatcagtccggctcttatggggggatgcgcggagcgggacatatcactctgcgtcctttcgcctcagggaagatttctggcccgcgtgaccggacgtgtacggggaaatgttctgctgcgcaaaaaacagtaccaggtctcccaaaatcaggatataagccttacaatatccaggaactgtattcttggaaaggtatacaatgccagatggatactggaaagggctgtgagggaccatgggctgcagattgacacagagaaggtaaaggatgcagcaggatatttaaagcaatcccttaagcggatagagcaaagccgggacatggctcagctgcggggttatgaaggtgaggctgccagtatttactttggagtgtttgaccagctcatattacagcagaagaaggattttgctttcaatggaaggaataagcgtccgcctttggacaatgtgaatgccatgctgtcatttgtatacacgctcctgacaaacacggttgcgtcggctttggagacagttggcctggacccttatgtgggcttcatgcacactgaccggcctggccgcgtttcgctggcactggacttaatggaggaactgagaccggttctggcagaccgttttgtattaaccttaatcaatcgaaagatggtaaacaaaaaggatttttccaggaaagaggacggggcagtcatcatggcagatgaagccagaaagatgctattgtcggaatggcagaacaagaaaaaagagatgattacccatccgtacctgaatgagaaggtggagtggggaatgattccttttgttcaggccatgcttctggccagatatctgaggggtgatattgatgaatatccgccgtttttctggaaatagggtgaaataggaagggggcgccggaggaggaaggcgtatgctggtattaattacatatgatgtgaacacggaaaccgctgcaggcaaggccagactgagaaaggttgcaaagcaatgcgtcaattatggtacccgcgttcagaattccgtatttgaatgtattctggataatgcccagctgataaagctaaaggcaattttgacagatatcattgatgaacagacggacagccttagattttataacttagggaataaacatactacaaaagtggaccatgttggtgttagtaagggaattaatgtggaggaaccattgattttctgatatgatgtgcaggagttgaaacggtaataggtgttccggtgcgaacctgaagcaaacatggatttccagggggattcgcaccagaaaaattgtataatgaggatggtattgtgaggatttaggcatgttttccgggatttggagggggtgttgtatgacttgtttgttggaatttgataagaaatgataggagttgttgtgtattattgctgtctccgccttcgcgggtggagtggattgaaatatttcctgccctatagataatgaacacctttttatgtctccgccttcgcgggtggagtggattgaaatcaagattttcattgctaaatggaaagtatattagtctccgccttcgcgggtggagtggattgaaatatgagttcggcctcccatacctgccgataatagtgtctccgccttcgcgggtggagtggattgaaatactgggatattctggacggtaatcatacatattagtctccgccttcgcgggtggagtggattgaaataagcgacaggcagaggaagattttaacgttgagtcgtctccgccttcgcgggtggagtggattgaaatcaatgggtattttgtgcttgatgaaaaaacagggtctccgccttcgcgggtggagtggattgaaatgtatatctctatccgattcccctatcttggataccgtctccgccttcgcgggtggagtggattgaaatattgaatgaaattaaaatagagttgaataaattgtctccgccttcgcgggtggagtggattgaaattaaaaaagtatgttgatatttcccctggtcattcgtctccgccttcgcgggtggagtggattgaaatgtacatattgtaactttacggatgaagaacgggcgtctccgccttcgcgggtggagtggattgaaatctccagtacatgcctggacatatgtgccctcagttgtctccgccttcgcgggtggagtggattgaaataaggaaagtggggccgccgacataattaagaagctgtctccgccttcgcgggtggagtggattgaaattggagcagttcccagagaccggcacgtttgaccgagtctccgccttcgcgggtggagtggattgaaattttgcgatatcgcaacaggaggaagggaagcatggtctccgccttcgcgggtggagtggattgaaatgctgcagccaagtccacagaatcagcagcgtccagtctccgccttcgcgggtggagtggattgaaatttatggttcatcggcgcttgagtatgtgaaagaagtctccgccctcgcgggtggagtggattgaaatcctactccagcctcatccatgcagatgacctttgtctccgccctcgcgggtggagtggattgaaatctaccagcgcattgatggtggcttcctctacaagtctccgccctcgcgggtggagtggattgaaatccggtaaggctccatcacaaggtctatcccctcgtctccgccctcgcgggtggagtggattgaaatgcatcataccgctttcaagcgacatcgaaccttccgtctccgccctcgcgggtggagtggattgaaatagctttaagattccctcctctggttggactgaatgtctccgccctcgcgggtggagtggattgaaatgttgaaacagcttgaatacatacctgttgggaaagtctccgccctcgcgggtggagtggattgaaataaaagtaggaatgtgcaagtgcgtggttggtcatgtctccgccctcgcgggtggagtggattgaaatcctgattactccatatatccggattgcgattatgccgtctccgccctcgcgggtggagtggattgaaatgccacacactggctggaaatgcaagggttgccgagtctccgccctcgcgggtggagtggattgaaatcacaatcgtctggtcatatgggactataggcaggtctccgccctcgcgggtggagtggattgaaatgatggcggacacagaaagactgattctttacgcgtctccgccttcgcgggtggagtggattgaaattaagaagaggtgtaaaaaccctaagcccatatctcgtctccgccctcgcgggtggagtggattgaaatcatggttttatacccaggattctgaacttgaagtttgtctccgccctcgcgggtggagtggattgaaatcttccattggggtgggggtactgttgattttcatgtctccgccttcgcgggtggagtggattgaaatagaattacatttgaagcatattgatactggctatcggtctccgccttcgcgggtggagtggattgaaatgcttgtatatgcatatatcccatctttcatcagagtctccgccttcgcgggtggagtggattgaaatccggatgcaatgtggaaagtggccagtcgcaaagtctccgccttcgcgggtggagtggattgaaattattgttagggccaggagctcaccctctcggattcgtctccgccttcgcgggtggagtggattgaaatggcagatggaaatcatgactggattgtcaaagtcggtctccgccttcgcgggtggagtggattgaaatgtccatacgcagataggactggatgtagccacatgtctccgccttcgcaggtggaatgtattgcaatagaacagtacatagctgaccttgcagcatagcggaataaaattaatatataagagaatagttatttcaactgtattttgtatacagtgcacagcggatacttccgactataaatgcataacaataaggtggggcaagccccacctctgttaatctataaaatgctgcaaaagagtgctgacaaaaacccatatttcagctgccccccattagcccttccacgcccgaatttctctaagtccaggtaccagcactttggcgctggtttccaatataatccgtcccttttccgcagtggcgccggacggatctccgccgattccaatgggtttgccgtccgctgtcttccagtcctcggatacccatccaatggatacattcccgtaaggcttcagcgcttgattatccttaaatgcatgcgggatgcctgcttctgaagtctccagttttaccagagacgggtccacggccatgaccatggaggtttccatttcgccgccatgaaaatcccatatatttccttcggagatggtggctgtcacatccggatgactaaaggccccggatgagaggatgaagggagatatgccgaattcgctgcggagttcccggcttaagacctgtacaatgggggcgtttcctccgtggcaaaccaggaaggccagcttcttaaacccgtgatggaccaggcttgtgctgatatcatacagcatatggtaataagtatccggtttaaacgtgacagagccgcagaaattcctgtgctccgtgctgagtcctacgggaatgaccggaaatatcagcatgggaaaatccgggtcttctgcttccaattccctgcatatatagtccgtcatggcttctgcaatgatatcgtccgtccccagcggcgcctggttgccgtgctgctccaacgctcccaggggaatcagtataatggtctcctccttgttgacctgctccatttctaaacgggttaaatcccgataattccgaatcatgtgtatatacctcctgattatttttggtaagccggttattccttatgccgttcttacagcgggataaaccgccagaagacgggtgtacagcagatatcccacaaagcagttgagccccagtttaatcaggttaaaggggatggtggccatgaagatgaaggtggtcagatcgctgatggccggattcactgcggctaccatagtaatcacctggttcagaggaagccccatggccgctgcatacaggggaagggtgatgaaggcattgcagaagcaggcaaacagagtacggattggaacactgacaaccatggatgcaatggctgcacggcgggtctttccgcctcttttgtaaacagtccatatgggaattacaaatagtgcaacccctatcaaattagcaaattcccctacatacatggaattggtacccaccgtgatgagtttaattatgattttgatgatttccacccaggctgcagagacaggccccatgagaaacagggcgatgatggaggggacatcactgaagtcaatcttgtaaaagggcggcatcatgggaacggaaaattccagggacatgagggcgccggcaaccgcagccagcataccggtgtagataagtttctgaatactccattttgttttcatagcaaaacctccttgataaatgcttattatacggtgattcagcaatgaatgaagttccaggtaacaaaaaatctcaggttccggggaacctgagattaacttcatggtcaatataaataaaagggaatgcctgttacttatatgaacaaaattgtcttctctcatccagactatactgtcggttttggaatcacaccaaatcagccgcatgcagcgggtcgcggactataccgccggtagggaatcacaccctgccccgaagaacctattcatttgcttttctcatttaaaattatcacaaataacattggctgtcaacagcaaaagatgcagttttttgttgctttttttacgattttgttgataatagatatagacgcatttttaaggctgattctggcatatgaaaggcagatttgacaggggaatcgacttccgatatactagaatgaaatgtatcccgttttttggcctgtctgcagttggattttccagctgggacggatggtttgtaaaggacaggaccctggcgggaaaccaataaggaggtaagtatggattggcagacactgctttgcgacgaccgcatccgcagctacaggaaacagtcctccacggacctgcggacggagtttgagaaagattatcaccggattattggcagtgcatccttccggcgcctccaggataagacccaggtgtttcctctggacagaagtgatttcatccgtaccaggctgacccattccctggaggtatcatccctggccaagtccctgggacaaaacatatcggagagcatccgtacgattatcagggatgaaacgtttacgcctgagcataaggcggcggtgtgtgatattctccagtgtgccggattgattcatgatattgggaatcctccctttggccactttggggagacagccatccaggattggtttaagaagaatcttgagcagcttacttttaaagggagaaagctttcagagattctaaagcctcagatggtacaggacttttgccattttgagggcaatacccaggcattcagggtggtgaccaggctccatttcctggtggatgagcatggcatgaacttgacaaaagcgcttctgggaactattatcaagtatccggtatcttccctggaaattaataaggacagcggcgatatccgtactaagaagatgggatatttccatggagacagggagaacttccgggatgtgcaggcgtcaacgggaacattgggaaaaagacatccgctggcattcatattagaagcagcagatgatattgcctataagacagcagatattgaggatgcggttaagaagggctgcatttcttatgaacgccttttggcggagttaaaggggtataaggccggaaaccagacagagcactatatccagattgtgtcatggctggaggataagtatgaaaaggccgtgagaaaggaatatgacaggccggaccaatatgcagtgcagaactggattatcagtgtccagggccagatgatttcaggggttacggaatgttttgccggcaactatgattccattatggaaggtacctatacctgtgacctttttgcaggcacggatgtggagctgctgatggaggcgctgggagatattgcattccggtatgccttttgtaccagacctatccttaagctggagatagcggcacagacaatattcaactttcttttggaccggtttgttgacgctgtgataccctacgatacggaccttcccatgacccaggtacagaaaaagctggtttcccttatatcggacaattataagatgatatattccctctgtgccagggacaaggacgatgaggaacggctgtatctgcggctgcttctggtgactgactatatctgcggcatgacagacacctttgccaaggatatgtatcaggagcttaatggaatccgttagaaggcaggaggcgtctgaaacaggtattccggcaaggacgcggtttaaaatagccggatggaggtctaatggacagtggaaataaattcagggcaagatgtggatatctggctgtgggtattgttgtatttttgattgagttaattatcgccctgtatgttcacgaccatatcatcagaccctatataggggacatgctggtggtggtgccggtgtactgttttgtcagggtgttcttacctggaggcataaagcggctgccgctgtatgtgtttctctttgcagcctgtgtggaggtactgcagtttttccgcctggttgagatactggggcttgagggaaatgccgcggccaggattatcctgggttcagtcttcgactggaaggatattgcctgttacggcgcaggatgcctgcttatacaaatatttgaaattcgaaggagggccttatgaaaggttatcagttgaaaattaccataaaaggcagtaaaccgcctatatggagacgcgtggtggtgccggagcagtttacgttttaccagcttcatcaggtgattcaggaggcctttggctggtgcgattaccatttgcacgagtttgagtttaagaaactggggctgcttgtaagggacctggaagaggaagacgattttgcggagctttgcagcagtgaggtgctggaggaaggaacacctattagaaccctcataacagagaaccctcgttttgtatatatctatgactttggggacgcatgggaacaccagattctcatggagaaggaagtggagtatgagggcagtcttccccaggtgttaaaatataagggggacaatattccggaggactgcggcggcataggcggttactatgacctgctggaccagctgtctgaccctgaggcagaggaacatgacatgatggaaaactgggcccgccagcagggaatgggcgagtatgacctggatgcagttaatgccaggttgaaggcaaatccggcatttaaacaggaggcagcaggaaacggacagcaggatgcagcccggcagcagaagacagcggggcagcagaagacagcggggcagcagaaggccggtaagcaggaatctctaaaacccgcacctccaaagaccgcaccgcaggcagtccatagtctggaggaccttttctccagatttgaaaaggctgagcttctgcgcattgccagggtacaccatattggaggctgcgatgagctgggaaagaataagctggcccctgcactggcagctgccctgctggatacgcagcgcatggcgggtttcttcggtaccttaagcgatgagggtgcggcggagtttgaaaaagctgccgcagccggaggtatggaataccagggagacctggatgctctcagatttctgcattacggcggttactgcggatttaccagcatgggaacagcagttgttccgtcagatgtggcaaaagcgtactatgagctggatacggagaaattccagtctgagcgtcattaccgcagccaggtgtgggcttgctgtaaggcagcggtctacctttacggcgctgcggatgcaggtcaggtggagacaatctgcaaagcggctggctgtgaggcaaaagccggtgatattacccgtctttaccaggagatgaaaggaatctggactgattttgcttattggaacggccggtttattgactgggaactggttcagggagacagctataaagatgttttgaattatcagagaggcaaggagttctatgtgcccaatgccgcacaggtaaaggagattgccagaacaggtgcagtggagcttaaaaagcatatccggccattgaaggcatttttcctggccatggtgggctgcgacgaggagactgcccaggtggcagcgtcctccattcatcatcatgtaagactggggacaacgcccaaagtagtagaagatatcatggagcattttggactgaacctggattcacaggaaaagatgaatggattcgatgaaatcatggaacaggtatggagggaaaccaggacggttggcggctgtggctacagccgggcggagctggatgccaagacagcccggattgacccggatgcgccctgtccctgcggcagcggtaagcgctaccgccagtgctgcggccggaaataaaaagcggaggtgtgaagcagccatgtttgaacgtgtggattacagagtggaacggattgacggggattacgcctatctgaagcgggcggatgctccggatgacgatgagaaatgcgttgccagggctcttctgcctgatggtatcaacgagggcagcaggctggcgtatgagatgctggagtatacgcttctgtaacatgccggagcggttgcggcgatatggataagaggcagtatggataagaagacagaacgtctggtcggtgtggccagaatgtattacgagcaggacaggacccagaatgagattgcaggcagatacggcatatcccgccccatggtcagcaagcttttgaaggaggcgcgggacagaggcattgtgtccatccgtatatgcgccccgcaggaggaatccggcagcccattgtccctcatggagctggtggggcgttgcttcgggatttacgatggtgtggctgtgcctgacggacccaatgaccagaccaccaatgaggcggtggcagaggcagctatcacctgtctggcggagctgggaggctccagcctgggcattggatggggccatatcataggggatgtggtaaagcagatggagcagagggaaaagctggtgccaatagggaactttgtctgccccctcataggaaacggcggtgtgggacttaagaattaccattccaacgagctggtgcgttccattgcagagcacagcggggcccagcccagatttatctattctccggcctgtgttctttctgagcaggagctgaaactgacaaaggagctggacacctatcgtgagatatatggtgtgtgggaaaaattggatgtggccctggtcaatatcgggaattttccttctgttccggatttcgcgtcggaggccagatatggggacctgctcatacgccataaggcagtgggacgtatcctgaattatttcatggacagcgagggacatatcatccggtcggatacggattacgccatccagattccgctggaacttctgtccagaacaaggcatgtggtgggaatctgctcagccaataccagtcccaaggcattcaggggagctttgaagactggttacatgaaacattttattgcgcctgagcatgtggtcagggaagcgctggaatgaggcggggacagataagaacatgggccggatatgccctaccccttcaatataatgttaatgtcagtggaatataatgtaaaagccaatagaatataaagttacatatgtaactcgaaatgcgcagtttgctaaagagactgcgctttttttgtgcattagggcaaaaaacatagaacagggacatgaataattgacaaaggaactaacaaatgttaatctaaaaccatgggtaatttggggaaaatgcatgagaggaggttacatatgttactttcgaaaccggaaatcataaaaatgttcagaaaagccgcccaggtctggaatgaaaacaaggattatctcagtgagattgattccaaattcggagacggggaccacggcgtcactattggtaagattgccagcctgattgagaagagcctggatggctgggatgacgacaatgtagagacatttctggaggacctgggagacaacaccatggaaatcggagggggaagcgcgggtccattatacgggaccatgataggaggactgtcaggccctctggaaggaaataagcccattgatgcaggaatcctgaaggagatgtttacagagtgcctgtcagccatggaagacatcaccaacgcaggcataggggacaagacaatgatggacgccctgattcctgctgtggaagctgcccagaacgctgaaaatgatgtgacggctgtcctggaggcggcaaaggaggcagcagccaggggagcaaaggacagtgagcagtacgtgtccaaatacggaagggccagaagctataaggagaagaccatcggcactccggatgcgggggcagtcagtacatccctgttttttgcaggactttgcgacgggctgaagtagatggcatgcagatgcagctaaaaaataaaatgggagaggtaagacaatgaaaatgaagaaatttattaacaatcctgagaacctgacacctgagctgttagagggctttgccgaggcgcataaggatttggtgaccctgggcgagaaccgtatgattatcaacaataagctggcggaggctgacagggttaccattgtgacccagggcggttcgggccatgagccggctatcagcggatttgtgggagagggaatggtggatatctctgtggtgggagatgtttttgcagctcccggaccccaggcctgcctggatgccatcaagatggctgataagggaaagggcgttctctacatagttttaaaccatgcaggcgacatgcttaccggcaatcttaccatgaagaaatgcgccaaggaaggattaaatgtcgtcaaagtagtgacccaggaggatattgccaatgcaccgcgctccaatgcagacgaccgaaggggcctggtaggctgtatccccacctataaaatagcaggagctgccgctgcagagggaaggagcctggaggaagtggctgccattgcacagcgttttgcggataacatggccaccctggctgtggctgtatcaggtgctacccatccggcaacaggaagcctgcttgcagacctgggcgaggatgagatggaaatcggtatggggcagcacggtgagggaggcggcggacgccagaccatgaagtcagcggatgaaacagcccaaatcatgctggacggccttctggctgacctggatatcaaggaaggcgagaaaatcatgctgattctcaacggtaccggcgcaaccacattgatggagctgtttatcatttaccgcaagtgcgtttcctacctgaaggaaaagaacattgagattgtggcaaattacgtgggcgagcttctcaccgtacaggagcaggccggattccagatgttcatggcaaggatggatgatgaacttctgcactactggaatgcaccatgcaatacgccgtatatgaaaaaataggaggatgatggtatggcagctgaatacatgcacataggaatcccggtcctgaacaaaaaagagggaatgacctataatgaggacatgaagttctgggtaagcagggttgaggactatgattttaagatagagtacctgaaattcgaggagggcaccccctttccggagattctttccaagcagccccatgtggcttataaggtggatgatttggaccactatgcagcacaggcacagagaattatattcgggccggctgactgcggccccggcgtgcgtctggcgtttgtaatctgggatgatgccgtcattgaactctacgaggaaaagtaaggagaagatgggatgctagtaaatatgaaccatgttctgcggtatgcagaagagaagcaatgctgtatcggagcctttgacacacccaatctggagattctcatggcagtcatacgggctgcggaaaagcgggaggaaccagtcatcatccagcacgcgcagcttcatgagtgcgaaatgcccatccacatcatcggtcccattatggtgcgtatggcgaaggaggccaaggttcctgtctgcgtcatgctggaccacggcgaggatttggactatgtaagaaaggcactggatttaggcttttcagctgttatgtacgacggctcatcccttgcttatgaggaaaatgttgccatgaccagggaagtggtggccatggcaaaggcctgcaatgcggatgtggaggctgaaatcggcattgtaacaggccatgagggcaagacatttgccatcaacgatgtgagcgaagcctatacagaccctgagctggctgccagatatgtaagggatacaggtatcgacgccctggcggcttcggtgggaacggtccatggcttctacgccaccaggcccaggctggattttgaccgaatcgtaaaaataaaggaactgacagggcttccccttgtaatgcacggaggctccggaatcagtgtggaggacacccagaaggccatccgctgcggtatccgcaaaatcaactacttctcctacatgtccaatgcaggcgtaaaggcagtgaaggcattgctggctgaaaaggaagtgaagtacttccatgatttggctaatgcagcagtggatgccatggagcaggatgtacttagtgctatggctatgtttgcgttggaataaagattcagaaatgaagaaaaattaaagtctatggtgattaataaaaaggaccagccagtttggataaaaatccggttctttctggactttgggtattccttataaaacattagctggtatcggttcgagaaaatcgctatgccacagccttggcaggccattgcgcagcgattttgttcaattggaattttgcgaaggagaggtttcaatgaaaaaaatcggtttaggtattgcgatactactttttgctatcataatttctctttgttcatcaggaatggggctactcgttatcggaattgggattgtagggttgattttttcaattataggatttatagaaaacaagtagtaggagcttcctgtataataaaaagcgtagacgttgaaaattgaaaatacctcagagtacaataagactactgactggcaggttagtaaaaatcttattgaacagagaggtatctacaatgaagtctaacacacagaacgcaaaaattgaagctattacagaaaaaactttggtactcggaatcgatgttggaagtgaaacgcactatgccagagcttttgattacagaggaatcgagtattcgaagaaaccatttaagtttagcaacacagaggctggatttgtgacatttaaggaatggatcctggatctcaaagatagacataagaaggataaggtggttccaggtatggaaccgactgggcactactggttcaatcttggaaagtttctacaggataatgaaatgaaaccggttcttgtgaatcctcaccatgtgaaaaaatcaaaagaactcgacgataataatccaactaaaaatgaccgtaaggatccgaaagttatagcaggattagtgagagagggacgttacatgatcccatacctgccggatggtgtttacgctgatcttagaacagcatcaaacataagattccagttacaggcggaacttacaagaattcaaaacaggatcagtcgttggttcaatatatattttcctgaatataagacggtatacggaaagccggatgccaagagcggaatgctgatccttaaagcagcaccacttcctgaagatatcctgatgttaggtatcgatggagtgaaccagatctggcgggatgcgaagttaagagcagttggaaaagcgagggcgaagaccctgatagaagctgctgagcacagcgttggaagcaaagaaggtgcggtgtctgcaagaatggaaatccgaatgcttctggaggactatgaatccagaaatacgcgtctacaggaagttatggttctaattgaagaactggtaaaagggattccgatggctgaaaagctgttagagatcaaaggtgtgggaatcaggacagtgtcagggttccttgcagaagtaggtgatattagccgcttcaacaatccgaaggaactgcagaagcttgcaggattggcattggttgaaaatagttctggaaagcacaagggcgagacaacaataagcagacgaggtcgaaagagactcagatacctgctctttgaggctgcaatgtcgcttgtggcgaagaacccggagttcagggaactccataattattacacaaccaggaggctgaatccattgaagaaaatgcagtcgcttatggtaattgcagctaagctgatacgagtcttttatgccatgttgactaaaggtgcggattatgatccgaaaaagatggtcagtgacatcaagagaccggcagtttatctacaggctgtgtaagaaagacaagtaactataatggaggctgtcatgtggacagccactgaatcaagcggaatgtaacagataacgtccactgatcacagtgctggaacaggaagcgagtcagtaatcaataatacaaagaatgagccagtagtcggaaggaatattttccatggggtgagaccccgtataggagcatggctgacaccctggttatgggcaggcaggacgaaggaagttaggacctctggagacagagatgatcctggtggatataggaggttagctgccatagagggaagggtatacacaaggccagtaaaacgaaaacaaagacgttttatttcgtataccattcaaccactatttcagtacctgatacatcgaaatgctcatagctgtggcttattcgctgagatatgaaaggttgaaaaaccttgaattttcaataaaaaacacttgattatatgaggaggtgtttttatgtatggattgcttgttttgaatttcatcataccttttgtaatggtttttgtaggatatatcttaaagaagcacccggtaaaagatatgacatcaggtaacggatacaatacgcctacatcccggaaatcacaagagcattgggattatgcacaaagcatagcgcctaatatttttattggtactggcaaaacattaggtttggtagaaatcgttttgtgtatatccttacttcttcttaatatttccgcacagtctaccgtattcgcaggagtagtcgttggaattatttttctgattttggggttttataaaacagaaacagggattacaagtaaatttgcgaacaaatagctttccatcttcgggccaacatgacccgaactttcaaaactgaataccagccgcccaccggcggcaccaccgagcaggaaatcttgaaacaggttccctgctctttttatgcccggacgccgggagaaaggaggacactgcttgccatgcccgcactttgatgtgaaaatcatccagcgcagcaagcgccagtcagccgttgcgtctgccgcctatcagagcggggaacggctgttttccgaatacgaccagaaacagaaatactattcccataaaagcgaaatcgtccacaccgaaatcatgctgccgccccatgccccgccggagtacgcagaccggaataccttgtggaacgccgccgaagcgattgaaaaacaatggaactcccagcttgcccggaggttcgtgcttgccataccgagggaacttccccggtcacagtacgccgaccttatccgggactactgccgggagtttttcgtttccaaaggcatgattgccgactttgccatccatgacaagggggacggcaacccccacgcccacatccttcttaccatgcgggcgatggacgaaaccgggaaatggctcccaaagagccggaaggtctacgaccttgacgagaacggcgagcgtatccggcttgcgtccggcagatggaaaagccacaaggaggacaccgtggactggaacgaccagaagtacgccgagatatggcggcagggctgggctgacacggcaaaccgctatctggaagccatcggcagcccggagcgccttgaccttcgctcctatgcccgacaggggattgataaaattcccaccgtccacatggggccagcggtcagccagttggagaagaaaggcatacaaaccaacatcggcaacctgaaccgggacatcaaagccgccaattccctcatgcagtctatccggcagatggtacgcagcttaaagggctggctgtccggcctgaaagagaaaaaggcggcgctgctggaagcgctggaacaggcaaaggagccgaccatccccgaactgctttcccggtatctggataaacggagcgaggaacgcaccgactggacttccaaggggaagctgaaaggcactgttggagatttcaacaaggtcatggaagcccttgacttcctgcggcagaaagagatttccaccgtggagagccttgacgcctatctggatgaagccagcgcacaggccgtttccatccgtgaggaaatcaagccgatggagaaacgtgtgaaagagattgaccggctgcttttccatatcgggaactttgaagcaaacaagccggttcatgtgaaatatgccgctatccgctggaagaaacccaaggagaaatatgccgccgaccataaggaggaactggacgcctacaacgctgccctgcggtatttcaaggttcaccttgatggggcgaagtacagcacaaagaagctggccggggaacaggcacagctttcagagaatatcgcttccaagacggaagcgctgactgccgtacaggaggatgtaaagattttgcgggatgtgcgccactggctcaatcaggttttgccatccgagcagtaccgccagaccgcagagccgggaaagaaaccgtccatccagcaggcagtcaaaggccgggagcagcgtatccgggaggaacaggcagagaaacgccagcagccccgccgccagcaaaaacaggatatggaactttaaccaatcaggcgcttgcctttcctttgtgagaatggcaggcgcttttcttgtatcaggaggatttgcctattgaatgtatttgaagccgtgaagcagtctgttaccacccggcaggccgccgagcattacggcgtccgggtgggaagaaccgggatgtgcgtctgccccttccatgacgataagaaccccagcatgaaggttgaccggcgcttccactgtttcggctgtcaggcagacggggatgtgattgactttgtttcccgtctggaaaacgtcagccccaaggaagccgccctcatgctggcgcaggacttctccatcccctatgaggataaggagccacccggcagaagccgtccgaagcgaaagccccgtcaggaaagcccggagcagcaatttaagagcatggagcgatactgtttccgggtactgtccgactatcacaatctgctgcgccgctggaagcgggactatgcccccaagacgccgaacgaggaatggcacccgtttttcgtggaagccttgcagaaacaatcccatgtggaatatctgctggatgtgctgctgttctccgatatgaggaaacgggctgccctgattgccagctatggaaaggaagtgaggaaccttgagcggagaatggcagaccttgccgcccgaactgcggcaggccgtgatggacaccatcgaagccgcacccccgccccggagcgttgaggaagtgaaagccatgctggaaagcaccgagaaaggcggcgtgcgcaacagtattcaaaactgcctgacggtattccagtatgaccccattctttccggggcggttgcgaaaaatctcctgaccgagcgtattgaccttctaaagcccatcggcaggaaacgcagaaccggcagcaaggccatgaccgatacggacatgaaatatatccggctgtatctggaaaagacctacggcctgacaagcgagaaaaggatagcggacgccgccgaccttgcggcagacgccaacagctaccaccccatccgggactacctgaacggccttgtctgggacgggaaagagcgtgtccgctactgcctgcggcactttctgggagccgacacggacaactacaccttccaatcgctgcggctgttcttgctgggagccatccaccgggcgttctgtcccggctgtaaatttgaagtcatgctttgtctggtgggcggtcagggagccgggaagtctaccttcttccggctgctggccgtgaaggacgagtggttttccgatgatttgcggaagctggacgatgataacgtgtaccgtaagctacaaggccactggattatcgaaatgtcggagatgattgccaccgccaacgccaagagcatagaggaaatcaagtctttcctcagccgccagaaggaggtctataaaatcccctacgaaacccacccggaggacaggctgcggcagtgcgtgtttggcgggacttccaacgccctggacttcctgccccttgaccgttccgggaaccggcgcttcctgccggtcatggtctaccccgaacaggccgaggtacacattttggacgatgaagccgcttccagagcctatcttgaacaggtatgggcggaagccatgacaacctacaaaagcggcgattttaagctgtcttttacccccgaaatgatacagtacctcaaagaacaccagcgggatttcatgccggaggacaccaaggccgggatgatacaggcataccttgaccgctacaccggcagcgccgtatgctccaagcagcttttcaaagaagccctgaaccacccctttgacgagccgaaacaatgggaaatcagggaagtcaacgacattatgaaccacggtatcacgggatggaagtatttctccaatccccggatatttgaagggtacggcaggcaaaagggctgggaacgggaagccccggcaacgggcgctgacaacgggcgtgaaaaaacgccggacggatttgtggaggtcacggagcagatggaacttcccttctgaaaaatccggggaaatgacagccggttgccgaccccgttgctatcccgttgccgggctggttgccgggaaaaagcccgtaactgcgggcttttctcccctctgacaaccaaagcaacagaaaaataaaagaaaaagtaataaataaccaaaccgccagacagagattgttttcgaggttttttgaagcccgttgccggacttcgttgccgaccctctcctgtctggcatatttcatttatggaggtaactgcctatggcaaaaaacaaaacagaaatccatgtcacaacagtatttgacggcgaactggacgctacggacgttttcgtgagcctgattgcacagaaatacagccagagaaatgataaagaatatcttgcgaaaaagcaagatttaggatataataaagacaaggttcagagtgaccgtgttccgtctggattgtgcgggtaacggttatgatgaacggatttgaatatacaggcgtagacgcaatactggcaggcagcttccgggcggctatctattgcaggctttccaaggacgatgaccttgacggggagagcgccagtatcgcaaaccagcgggctatgctggaaacctactgcgagaagcagggatgggaggttgttgcagtctatcaggacgatggctacacggggctgaacatggagcgccccgacctgaaacggatgttgaaagccattgagcgcaggcagataaaccttgtggtcacgaaagacctgtccagactgggtaggaattacttgcagaccggcttcctgattgaagatttcttcccccgcaacggcgtgcggtatatcgccatgaatgacggtatcgacaccatgcgggacaacaacgatattgcaccgttcaagaacatcctcaacgagatgtacagcaaggatatttccaagaaggttcattcctcttatctgctgaaagcgcagaaaggccagtttaccggctgccttgcccccttcgggtatcggaaagacccggaggacaaaaaccatctgctgattgatgaggaaacggctcccattgtccggcgtctgtttgcgtgggcgctggaaggacacggccccaactacatccggcgcaggctggaagatgaaaaaatcccatgcccgacctactggaaccgggtgcggggctttcggaacgtgtcaaccaagtgggaaaagaaagacccggtaaacgggcggtatatgtgggatttctccgtgattaaggacatcctgatgaaccccgtctacaccggcgctatcgcttcccagaagaaggaataccgcttcaaaatcggcaccatcggggagaagaagccggaggactggattgtggtggagaaccagcatgagccgcttgttgaccgcaagacctttgacatcgtgcagcgcaagctgaaatcccggcagcgcccccgccagaccggggaaatcagcctgtttgcggggcttatcaagtgcggcgagtgcgggaagtcgctcactatccgctacaccaacgacaagcacccgaagcaaatttattcctgtaaaacctacaatgcctacggcaagcagcactgtacccagcaccgggttgagtacgacaccctttacagccttgtgctgaacaaaatccgggagtgcgccagagccgccctgatggacggggaagccgttgccgggaagctgaccgacacctgcgaagccgagcagaaaggccaacgggaagcattggagcgttcccttaccaaagacgaggaacggattgacgttctggaaaagatggtgctgcggctgtatgaggacatggttgccgggcgtatcagcgaagcgaacttcaatctgctgatggaaaagacgcaggcggaacaggccgagttgaaagcaaaggtcacggaaggccggaagaagctggccgatgaaatccggcttgcgtgtgacgcccgccagtgggtggaagccattcaggaatacgccgacatcacggaactggacgccgccacccttaaccgcctgattaaagaaatcgttgtccatgagagcatagacagcgataagacaagacacatttctatcgaaattcatttcaatctcaaacccatcccggaggtggagcaggtcacagcctgacctgcccccgccggggcggttcttaaaaactccatagatatttcttgacacgccgccgcccgccatcgagccgttttcctacacctatttggggataaaacagcttatggcgggcggcggcgttgcccttatcggcatgacccttgtaccgctgctttccgggctgttcggttaagaagcgcgggtaaaggcttatgcagagcatacttgacgcgattaacgaatggataaaggaaatcctcataggagccataaacggtaatctgtcaactatgttcggggacgtaaacgaaaaagtcggcactatcgccgcagaggtagggcagaccccgcaagggtggaacgcaaatatattctccatgatacagacccttagtgagaatgtaatcgtacccattgcggggcttgtcattacctacgtcctatgctatgagcttatcagcatggtaacggaaaagaacaatatgcacgacgttgacacttccatgttcttcaagtgggtgttcaaggcgtttgtggcagtctaccttgtgacgcacacctttgacatcactatggcggtgttcgatatggcgcagcacgttgtttccggcgcggcgggggtaatcggcggcagcacagagattgatgttgccgccgcccttgcttccatgcaaagcgggcttgacgctatggaaatccccgaactgctcttacttgtcatggaaacaagccttgtgagcttgtgcatgaaaatcatgtccgtactgataaccgttatcctctacgggcgtatgatagaaatttacctttactgttcggtatcgcctatcccgtttgcaactatgactaaccgggaatgggggcagataggaaacaactacctaaaatccctgttcgctatcggttttcaaggcttcctcattatgatatgcgtcggcatttacgcggttctggtaaacaacatgataatagcggacaatctgcacagcgcgatattctcccttgcagcctacaccgttatcctctgtttctccctgttcaaatccggcgcactggcgaagtcgattttttccgcgcattagcggcgtgtcaagggcagggtggagattttcagagcgaagcggcgaaaatacgacccgaccttgacgcggataacccccatataatacgggcgggcaaagggcatagattgacctttgccttgattacccttatggaaaattacagcaacaccaaacccagagaaaggaggttttcacttggcgtatgtacccgtacccaaagacttatccaaagtcaagacaaaagtagcgttcaaccttaccaaacggcagattgtatgttttgcggcggctctcctgttcggcttgccgcttttctttctgctcaaagacagcacaggcaccagccttgcgtctatggctatgattgccgtcatgctgccctgtttcctctttgccatgtatgagaagcatggacagccccttgaagtggtggtgaagaacatcattcagacaaaattcatagcccccaaagaacgaccatacaggacagacaacttttattccgtcttagaacggcagagaaaacttgaaaaggaggtatcagcgattgcaaaaggaaacacgaagaaacagcgcggcgggaagcgcaaagcctaacccgccccgcaagctcacccgcgccgagaaaaagcagattgcggaaatcatcagacaggcaaagggcgacgggaaagcgcacaccgcgcagcagacaatcccctatatccagatgtacccggacggtatctgcaaggttacgcagcgcaaatactcaaagaccgtcgcctttgaagatattaactatcagcttgcacaggcagacgacaagaccgccatttttgagaactggtgcgacttcctaaactactttgacgcttccgtttcggtgcagctttctttcatcaatcaggggacgcagcggggcgaagcggaaaaggcggtcaatatcccggcacaggaggacgctttcaattctatccgcacagaataccgggatatgctgaaaaaccagcttgcaaagggcaacaacgggcttgtcaaggcgaagtatatcacctttgccattgaagccgacagtctgggcgcggcgaaatcccgccttgcccgtatcgaaacggacgtgctgaacaactttaagctcttgggcgtagctgcccgccccatgacaggctatgaacgccttaaaatgctgcatggcattttccacccggagggcgggcagttttcctttgatttttcttggcttgccccgtccgggctttccacaaaggactttatcgccccgtcctctttccgttttggcgaggggcgttatttccgcatggggcgcaaaatcggcgcggtttcattccttgaaatccttgccccggagttaaacgaccgtatcttatcggatattctggacttggaaacgggcgttatcgtcaatctgcatatccacagtatcgaccagaccgaagccataaagacaatcaagcggaaaatcaccgaccttgacaaaatgaaaatcgaggaacagaaaaaagcggtacgcagcggctatgacatggatataatcccgtccgaccttgccacgttcggcagcgaagcgaagaacctcttacaggacttgcagagccggaatgaaagaatgttcctcttgacgttccttgtggtgaacatggcggacacgaagcggaaactggaaaatgacgtattcgcggcggcgggcatagcacagaagaacaactgcgccttaacccgccttgactaccaacaggaagcggggcttatgtcctctgtaccgcttggggagaaccttatccccattcaaagagggcttaccacgtcaagcaccgctatctttatcccctttatcacacaggagcttttccagacgggcgcggctttgtactacggcttgaacgccctgtctaacaacatgatactctgcgaccgcaagcagctaaagaaccccaacggcttaatcttgggtacgccgggaagcgggaaatcctttgccgccaaacgggaaatgacaaacgctttcctcattacagacgacgacattattatctgcgacccggaagcagagtatttttcccttgtgcagcggcttgacgggcaagtgatacggttatcgcctacgggcaagggcattgacgggaagccccagtatgtgaaccctatggatattaacctcaactattccgaggacgacagcccccttgcgctgaaatccgactttatcctctccctctgcgagcttgtcataggcggtaaggagggcttgcagcctgtcgataagaccgtcattgaccgcgctgttaggaacgtgtaccgccctttccttgcagaccccgacccggagaaaatgcctatcttgggcgacctctacgacgagcttttgaagcagccggagccggaagcggcgcgtatcgcggcggcattggagctttacgtttccgggagccttaacgtattcaaccaccgtaccaacgtggagctgaacaaccgccttgtctgctttgacatcaagcagcttgggaagcagctcaaaaagttaggtatgctcattgtgcaggaccaggtatggaaccgcgtcaccgtcaaccgggcagaaaggaaatccacccggtattttatggacgaatttcatcttctcttgaaagaggaacagaccgccgcctattccgttgaaatctggaagcgtttcagaaaatggggcggcatacccacagccattacgcagaatgtcaaggatttgcttgcttcccgcgaagtggagaatatctttgaaaactctgattttgtcctcatgctcaatcaggcggcgggcgaccgggctatccttgcaaagcagctcaacatctccccgcagcagatgaaatatgtcacccacaccgaagcgggcgaggggcttatcttctacgggaacgtggtgctgccctttgtagaccgcttcccgaaagacaccgagctttaccgggtaatgacgacgaagccggaggaagtaggcgaagcatgaacgggctgaaaactgacaccatcatcaaccgcgacgcgctctatgccttgcgggagcttccagaggaaagcgtacactgttgcgtcacaagcccgccctactatgcgcttagagattatgggcttgatatgcagattgggcgggaggacacgccggagcagtacattgacaggctgaccgaggttttccgcgagctgcgccgggtactgcgttctgacggtacgctctggctgaatatcgcggacacttactgcggcacaggaaataaaggctaccatgcagacccgaagaacccgaaaggcagaaacggacagcagattgcaagaaacaaccgcgtttccggctgcaaacaaaaggacttaatcggtatcccttggcttttagcctttgccctacgcgctgacgggtggtatttacggagcgacattatctggcagaaagaaaaccccatgccggagagcgtgaaagaccgccctacccgctgctatgaacatatctttctgcttacgaagtcaaagaaatatttctatgacgcagccgccatagccgagccgttagcccccacaacggcggcgcggtaccgcaccgggcgcagcgcgggacagaaatatgcggacgaaatacccggacaggggaaagtacaggggcttaaccgggcgcgaagcggcagctactacgacgaagccctcatgccgaccatgcggaacaggcgggacgtgtggcttatcaataccgttccctacaagggcgggcatttcgccgcgttcccgccaaaacttgccgaaacctgtatcaaggcgggctgtccgaaaggcggcgttgtgcttgacccctttttcggcagcggcacgacgggggcagccgcaaggcagcttgacaggcattatataggcattgagataaacgccgagtattgcgcccttgcaagggcgcggattggagggacagaaaaataaaacagtatcgagcgcgtgagaaagtcacgcagaaaatgacccgcgagggggctgtcgaggtaaacgccgccaccgggaaaaagaaacgtatcagcaagcggataagggacgcggactttgcaaagaccgaagcaccgcagccgccggaacaggcagcgcagcccctaccgggcggcgcaacttccccgcccttaaccgacacgccgccacttccccatgcgccgggggcagaacgggaacaggacaccgccgcagccgagcgcgtcttggagcgtatcgacggggcgcgtaccagaaaggcgagcaaaaaggcggcgaggaaagcacaggcagaagccacagcaaaagaaaaatcttcccgcttgcagtttaccgacgaggaacgggcaacgccggagcttgaaaagtatatccgaaaatcggacaaagcagccgaccgtctggacgcggcaaaggcggctatccccaaagaaaagaaacttgtacgggagcgcacctttgacgaagctaccgggaaaggcaagacccgcctacgctttgaggaacgggaaaagcccataggaaagaataagccccacaataacccgctatcccgccccgcacaggaagcgggtattttcgtccacaacaagatacattccgttgaaaaggacaattccggcgttgagggggcgcacaaatccgaagaactggcagagcgcggcgcaaagtacggggcgaggaaagtcaaggagggctaccgcagccacaagctgaaaccctaccgggcggcggcaaaggcagagaaagcggcgttcaaggcaaatgtggatttccagtaccacaaagccttacatgacaatccgcagattgcgagcaatcccctttcccgcttcatgcagaagcagcaaatcaagcggcagtatgcaaaggcagcgaaaaaagggggcgcagccacagcaaaaaaggcagcggagaatacaaggaaagcggcaaagaaaaccgccgaggaaaccaaacgggcaatcgcttttgtagggcggcacccggcgggcgtatgtatcgccgttgccgcgctgctcttattcatcatggtatcggcggggctttcctcttgcggttccatgttctccggcttgatgaacggcatacttgggacttcctacacgtcggaggacagcgaccttgtggcgacggagaacaattacgccgcaaaggaaaacgagcttcagcagcagattgacaatatcgaaagcacccaccccggctatgacgaataccgctatgaccttgacagtatcgggcataacccccatgagttagcgtcctacctcaccgcccttttacagacctacaccccgcagagcgcacaggcagaactaaaccgcgtctttgccatgcagtacaccttgacgctgacggaagaaacggaaatccgctaccgcacagaaacaagcaccgacccggaaacaggggaaacgaccaccgaggaagtaccctacgagtaccatatccttaatgtgaagctgacgaacaagcccatttccgagattgcggaggaacttctaacgccacagcagcttgaaatgtaccgcgtctatctggaaacaagcggaaacaaaccgctgattttcggcggcggctcccccgatatgggcgcgtccgaggatttaagcggcgtacagcttgtaaacggcacacgccccggcaacaccgccgttgtagaccttgcaaagcggcaagtcggcaacgtgggcgggcgacccttttggagctggtacggatttaacagccgcgtggaatggtgcgcctgtttcgtttcatggtgctacaatcaagccggaaagagcgagccgcgctttgccgggtgccagtcacagggcgtaccctggttccagtcacgcgggcaatggggcgcgaggggctatgagaatatcgcccccggcgacgctatctttttcgactgggacggggacgggagcgcagaccatgtggggcttgttatcggaacggacggggagcgcgtctataccgtcgagggcaattccggcgacgcctgcaagataaagagctaccccgtcaattactcctgtatcaaaggctatgggctgatgaactggaattaacatatttttgagcaaagaaaggagaaatttatttatggctatgaacaaaattgaacgtatcgacagggagattgcaaagacccgcgagaaaatcaccgagtaccagaacaaattaagggggcttgaagcgcagaaaaccgaagcggaaaacctgcaaatcgtacagcttgtgcgctccatgcgcctttccccgcatgagctttccgctatgctttccgggggcggtattccgggcatggaagccgcgccgggctaccccgcagaacccgcagaccatgacaccgaagaaatggaggacaccgagaatgaataagaaaatccttagaaccttgaccgcactttgcgccgcccttgtacttatgggcggcttttccgtcaccgcttttgcacagaccccggagggagaggacgacaccaacgacagcggcgttgtctacgaggaaccccaaaaggaagaaccccttaccccggacgggaacgcgacccttgtagacgatttcggcggcaacaagcagcttatcaccgtaacgaccaaaaacggcaattacttttatatcctcattgaccgggacgacgagggcgaggacaccgtacatttccttaatcaagtggacgaagccgacctcttagcacttatggaggacggaagcaccgaagcagccccgcccgccgtttgcagttgcaccgataaatgcgaagccggaaaggtaaatgtgagctgccctgtctgcaaggacaacatgaccgcttgcagtggcaaggaagcggagccggaaaccgagaaaccaacagagcagcccaaagagaaaggcaatacaggcgggcttgtgcttttccttgtcgtggcacttcttggcggcgggggcgcgttctattattttaagtttatgaagccaaagcagaacgtcaagggcgacaccgaccttgaagatttcgattttgacgattacgacgaggacgagggggacgggctttctgatgaagaacaggaggacgaggaagcatgaggcttttcaccgaaaatcctttggaaaaaatgatggtacaaagacccaccgggcggcgtgacagtgcgccgcccgttccaaaatccccggcgtgtgtgcgctgcccttataaggcgcaatccccctgtatcggctattgtctgaaacaggcacaggagaagaagcacaccgcgccggaacgctgaaaggaggattttttcatggcacttagacttgtgattgcagaaaagccgagcgtggcgcagactatcgccgccgcgcttggcgttaaggaaaagaaagacggatatatcgagggcgtcggctacctcatttcatggtgcgtcgggcatttggtacagcttgcggaagctgccgcctacggggagcaatataaaaaatggagttttgacagcttacccattctgccggaggaatggcagtacgccgttgacccggacaaggggaagcaattcaagaccttaaaagagcttatgcaccgcgccgacgtttccgaagtggtgaacgcctgcgacgcggggcgcgagggagaattgattttccgctttgtctacgaagcggcgggctgcaagaagcccatgcgccgcttgtggatttcctcaatggaggacggggcgattaaggcgggctttgcttccctcaaagacgggcgggactacgacgcgctctttgcgtctgccctctgccgcgcaaaggctgactggcttatcggcattaacgccacccggcttttctcctgcctgtatggaaagaccttgaacgtggggcgcgtccagaccccgaccttaaaaatgctcaccgaccgggacgcggctatctcccatttccagaaagaaaaatattatcatgttcgccttgatttatccggcgcggaagcggcaagcgaaaggatttcagacaaggcagaagccgacgcgctgaaaggggcttgcgaaacagaaacggcggtatgcgtttcccttaccagagagaagaaaaccgcagccccgccgaagctctttgaccttacctctttgcagcgggaagcgaaccgcattttcggctacaccgcgaaacagacccttgaccttgcacaagccctttatgaaaaaagactgcttacctatccgaggacggacagcagctttcttactgacgacatgggcggcaccgcagcgggcattatcgcgctgctttgcgaaaagctcccctttatggcgggcgcggacttcacgccggaggttgcaaaggtaacagacagtaaaaaagtatcagaccaccacgcaatcattcccactatggagcttgcaaaggctgacccggacgcgctgccggaaagcgagagaaatatcctcacccttgcgggggcgcgtctgctccttgccaccgccgagccgcatatctttgaagcggttacggcggttttctcatgcgccgatacggagtttacggtgcggggaaagactgttatttctgacggttggaaagagatggaacgcagataccgggcgacgctgaaagataagcccgaagcggaggacggggaaaatgcagacgtgacgctgccggagctttccgagggacagggctttcctaaccccgccgcaaaagtaacggagcatatcacaacgccgccgaagccccacagcgaagcaagccttttgtcggctatggaacgcgccgggaacggggacaccgacccggacgcggaacgccgggggcttggcactcccgccacccgcgccgccgtcattgaaaaactggtaaagggcggctttgcagagcgcaaaggcaagcagcttatccccacgcagaatggagccgcccttgtatcaatcttgccggatatgctcacttccccgcagcttaccgcagaatgggaaaacaatctgacgcagatagcaaagggagccgcagaccccggcgaatttctgtccggcattgaagctatggcgcgggagcttgtgcggacacacgccgcagcacttgacgggaaaaaggatttgttccgggaggaaaagccctctgtcggcaaatgcccccgttgcggttcccccgtccatgaggggaagaaaaactattattgcagcaacaaagaatgtgcctttgtcatgtggaagaacgaccgctttttcgaggaacgcaagaccgctttttccgcgaagattgccgccgcgctccttaaatccggcaaggcaaatgtaaagaagctctactccccgaaaacaggcaagacctacgacggaactatcgttctggctgacactggcggaaaatacgtcaactaccgtatcgaagtacagaagaactaaaaacttgaatagcaagcataggaagcgggtacccacttccgtaaatccccgttgcgacgctgacgcgccggacggggattttgcttgttgggaagtttcccaaaccctcttttgcggagggcttcaccctctaaaaattttcaaaaatatttggcagaaatgcgggcgtacccgtagtagaccatgcagccaaaaaatgcagcttatgacgctgccgcagagaaaggaggtttttcactatggcaagtttacgggacaccgtaaaggactatcaagacgagcttagggacggtatcgcatgggtggcgttctggaaacaggggcgttcatggaacgcggaatattttcatcttgatatggacgatacgctctacccggaggacaggagccggttagaggaaataaaaagcattgaccccgccgccgttatcttaaacggctactattgcgggcatttaggcgaggacatgagccttgacgagctgaccgccggagtgcgttaccactacgaaaacagcatgaacgacattgacggttttatcggagcgcatgacgacaggcttcccccggaggttatcgaggaagcgagggcagccgcccatgaagcggggcttcccttttccgaaaagccctaccgggacggggaggattttaacccctatgtatttgacgggagcatgagcattgaggattttgagcttatgcaccgcatgattgaaaaagaaaggagcgaacaaatggcagaaccgattttaagcggctatctttccaatcttgggaagtacaccgagggcagacccgcgggcgaatgggtgacattccccacgactgccgaacatctgaaagaagtctttgaccgtatcgggattgacttcaagcactatgaggaatggcatttcacagaatttcaatccactatccccggcttgacggagcatttaagcgagtattcccaccccgacgagctgaactatttagggaagctcttggaaatgcagtttgacgacgaccgggagaaattcattgcagccattgaatacggcgaccatgccgacagcttacaggacattatcaaccttgcacagaaccttgactgctactggatttatccgtccgtccacaatgaagaagaatacgggcgttatctggttgatgaactggaagaaccggaacttcccgaagaagcgaaaaagtatttcatgtatgaggaatacgggcgggacgcttccattaacgacgacggtatgtttaccgaaaagggctatatctacaacaaccgcaacacctttacagaatggtacgacgggcgcgacgtgccggaggaataccgggtaacgccgcagcccccgcagccggaaagacccgacccgtcaaaggtagaaatggacgcagccgcgccggggcagagaacggcgcagaccgcagagcagccacaggagccgcgcccggttatccctatcgtgctgacgagcgagaagcccgccgaaaagctcaaagagattaccgaccgtctggaacagggtattgcggaactctttgacagcgagcgttaccgggaatatctgaaagtcatgtcaaaattccataattacagcttccgaaacaccgtccttatcgccatgcagaagccggacgcttcccttgtggcgggcttttccgcttggaagaacaactttgaacgaaacgtgatgaaagggcaaaagggaattaaaatcattgctccgtcaccctataaaatcaaacaggaaatgcagaaaatcgacccgcacacgcagaagcccgttatcggcaaggacgggaagcccgtcaccgaggaaaaggaagtcaccatacccgcctacaaggtggtatccgtctttgacgtttcccagaccgagggaaaggagctgccggacattgcggttgacgagctgacaggcgacgttgaccgctacaaggattttttcgcagcccttgaaaagacttcccccgttcctatcgcctttgagaatatcgagggcggctctcatggctactaccacttggaggacaagcgcattgctatcaacgagggcatgagcgaattacagaccttaaagaccgctattcacgaaatcgcccatgcgaagctgcacgacattgacctcaacgcgccaaaggacgagcagcagccccacgttgaccgccgcacccgcgaagtcgaagcggaaagcgtcgcctatactgtctgccaacattacgggcttgacacgtcggactactctttcggctatgtcgccgggtggagcagcgggcgggagctgtccgagctgaaaagctcccttgaaacgatacgcagcgcagccgccgagattatcaattccatagacgagaacttagcggagctgcaaaaggcacaggacaaggagcagaccgccggacaggagcagcccaccagagagggacaggaagccgcgccggagaagccggagccggaagcagccgcaccgggaaaatccggcgcacaggaaaaagcgggcgcagccccgaaagaagcctttaccccggaaacgatttacagagtgcgccggaacctttacagcgacagccgggaaaacagctacctcttgcaagcctatgtgacacaggagaacgggcgggcgaaaatgggcgacgtgctttatacgggaacgccggagaaatgccgcgagcttatggggcagctcaaaagcggcgagctgaccgagggcgacgtgaagcagctttacgcaaaggcacaggaaacggcgcagaccgccggacaggacaaagacaccttttccatttaccagataaagggcggggacgaaacaagggatttccgctttgagccatacgaccgcctgcaggcggcgggaaatgtggttgacagggcgaactatgagcttgtctattccgcgccccttgcgccggaaacttcccttgaagatatttacacctgtttcaatatcgaccaccccaaagattttaagggacacagcctttccgtttccgacgtggtagtgcttcatcaggacggacaggacgcggcgcatttcgttgacagtgtaggttttcgggaagtgccggagtttttacaggagcaaaagcagcttaccccggacgacttggaaacgggcgaaactgtcaagacaccgagggggactttccatgtgaccgccatgagccgggagcagatagaagccgccggatatggctttcaccaccagtcggacgacggaaagtatctgattatggggaatgggacgcgggcgtttgccgttgccgcagaacaggcgcagcgggacaatcccttgaaaaccgccgagcagaccacagagcagaacgggaacatgattgacggtatcatcaacaacacccccaccgttgacgaactggaagcaaaggtaaaggcgggcgagcagatttcccttgttgacctggctaacgctgtcaaagccgacaaggagcgcggcaagggagcgaagccggaaaagaaaccctctatccgggcgcagcttagagccgacaaggaaaaggcacagaagaaaaacgcaaagcagaagtcacaggacttggaaaggagctgacccatgccggaacagagcaaatttgaaaacatggatttgtttgcttcccttgaagcgattatgaagcagaacacaggcttttaccagagcgacttagacattgacaaagagattatcgcaaaggcggcggcaagcccccacagggaggacaaaacacttttgtggttctgccgcccgtccgggacgcactgtttccgggagcgcgacgttttcctcaaagacaccgcgccccacaacacatggcgtttctacatggagcagacaagcgaccgcgttcttgcctatgcaatcgagctgacgggaaaggagcgcgggaaaatcaagggcaatctgtacgaactggactactctaaacattatgagcgcgtcaaggaaaaggagctgcccgccgatacggtgaagctgatttatgagcatggggaaagggtacaggaagccgggagatattttgacggaaccccagacccgcagcttgggaaatttgaacgctttgaagccgtacccaacgacccggacgcgctgcaatcgctcttacaggaagaacggcgcagccgggagcagctttcgccgggggatttcaaggcgcatattgccgctttgcgggacgggctgattgaaacggaagcgcggcgcattgtgcgagaaatgaagcggcattacgagccgaacagcccgaacaagacccatttcatggcagagctttccccggcgttcatgcggcttgcagccacaaaggacactgaccgccttttctccatgctgccctacaagaccctttccttttccaaaatcgagggcagacatgggacgtatgcgctgattgacaagggggagaaccgggacagggagataaggaagccccgcccctctatccgggcgcagcttaaagcagacaaggcaaagaccgccccgaaaaaggcggcggcaaaaacaaaaaatcacgatatggaggtatgagcatgattagactgactgttgaagaaacaaaccttttgagcatttacaacgagggcggcaagcgggctttgattgagaatgtcaacgccgcgctgccctacatggacgcggatatgcgggagcttgcaaagcgcaccctttccaaagtggacgctttgaccgaagcggaatttgcagagcttcccatttacgccgctgatgaagtatgaacggggttaagcggctgacgccgccccagagccggaaagtcaacgcccttgtgcgccggacgtgctgcaattatgataacgggaactgtatcttactggacgacggggacgagtgcgtatgtccgcagctcatttcctattcgcttctctgcaagtggttccgggttgcggtgcttcccgccgacaggctgctttatgcggagctttaccagacaggggataagaagaaatgtaccgagtgcggcgcgttctttgcgtcaacctctaacagtgtcaaatactgccccgtctgccggaaacgtatcacccgcagacaagccgccgagcgcatgaggaaaagacgcgcccctgttacgcagtaggcgcggaaaatcccttgatttacagggctttccgggcgtgaaaatcggataggcgatactttatacctttacccccaaaaatggcgttctactgcgtaacattcacgaaaacagcacccataaaaagacagggcgcggaagtcatatactggcttccgcgccctgttctttttttgcctatctgacatttcccttttccatttcttcaagcgggaactgcgggagggcttctatcagcttctttgtgatggactggcgcatatcttcgttgatttcctgtttcgtgcttccgtccggctgtctgaccgctaccgtcgatagcctgtcgatttcgtccttgtagcactccacgactttctccaccgcccatttttccccggcaacggcggcgcgtatggtttcatattccggcattttctggttttccatgctcaacgctcctctgctttttgatagccctatcatagcacagcggcggggattttgctatccttatccgcgctctgttcccttttcccgttccggctgcctgtctgcctgtaaaatgctgtcaatgttctgcttgataatatcgtattcccggactttctttttcagcttcccatagtcggcataaagggcttctttctgcgcttggagggcttcatattccgattgcagcgcggcaaggttcgggagctttgcaatgcccgccgctttcagcgaccttgcggcggcttcatgtaggataatcgcctgttcctgtccggcgcggtacttctccctgttccttgccttgcggtatgcgtcatagacgggctttgtcttttggtaggtggaaacattcttgataagcaccgccatgtccgcaagccgcttttccgcgtccttcaatgcgtctgccgcctgtccgctttccgctgccatttcttcaatccggctgactaaatccgcgtactgttcaatcttatgttccgtcaagaaattcatggtctttgctgcctgtttcagattgtggattttcgcccactgttcatagcccttactctgcgccgccttgatactgttctcaatgtcgataagcagcgaaacgccgcgctgctctctgggggctttcgccgcctttgcccgtctgcccgctatccgttcccttatggcttcctctgtataatccgcgccgagggttttaagacgggtgaagcgttcctgtccgggggcgcggcatgacacatatttccccggctttatctcatagcccgccgcctgtaaccgctgcaacaattcctcaaaactggaaacttgggggataagcgcgtcaacggcaatctttagcttgcctttccaacttgtacccgtcttttctgcctggtactccgcatagctctttcccttgctgcccttgccgggaacgacgacggacaagccattttcccgacacagcttgtcgctcatgttccgtatgccgtaatagctccttttgttggaattatatttgcggtggtctacgaaatttacggcgcagaaaataatgtgattgtggacgtgtcctttgtcaatgtgcgtcgtgagtacatattcatgctgcccctttgttaccgcgtcggcaagctgctttccgatttcatgggctttctgataatcgacttcccccggctcaaaggactgtatcagatgaaaggctaaattgttccccttttggagtgcttgggacaaggtatattcaaattcaatatctgccgtttcataggagcagccgaaagaggacacaagcatttttccgtccgtcttgtccgggttttcgatatagtcaagggctttgcttagagtgcttttaataggcttaatctttgtaaccgccatatctccgcaagcaccccctttatttcctctatgtcctcttggtatgcgttccccgtcgcgtttacgcggcgtgctatctggttgacgttgacaccgattttctgtatctctgcggtcattgcctttatatcggcatggtctatctgaatgatatacccgtcaatggcaatcttccgcagatatgccgccatgttccgggtgggtacgagcttcattttttccagtattaaatcccgttccgcttccgtcactctgaatttgatttgcaccgttcttttgcgtccgttcatgtattcgctcctttcctttccgttccgagggtttgggacacttcccaacaagcaattttcaaccgacgcgccgcagcgcgggaggggaaaatacggaagtgggtacccgcttcctatgcttgctacgaatgtttttatcctttaggctcttatcacctactacggagaaaaagcgattttgccaaacttacgcaaaagaaaaacgctgcaacctcaaaaaagattacaacgctttctaaatcctgttcagttttaagtcggacattcctattcgccctctttttcgacttcggaaatctcctttgccgttgcggttacaatccgtatgcctgtatcgctcataccgtcaagaagcgcgtcaagctgccgccgctgcgtgttcttctccggcggcgtttctaaaaggaattggtctacggatatatggtaacgctgtatcagctcaaagaatatctgtaaacttgggtgctgccccttgttctcaatgttcgcaaggtagcgcggcgagataaacatttcgtcgcctactttcttgcggctctccttgcatccctcacgcgctgcctttatcgctgccccaaaagccttaaagtcgtatcgtggtactggtctttttgccatagttattcaccctattacattttactgttcccctttcttcttggatatgtctacgtagttctatcagttagccaaaataattcatatatatatatgttgacaacaagctgcttttgtatataatattatataaaagggggggaatgtttatgttacatagcatgcgtattcgataagcattgaaatcaaaaaagatttttcccattttcaatatgggcttttttgtcatgcttattttgcgtatgctatacaacaaaactaacgacgtatagacatagtataaaaactatgccttaattttgttgtagtattatatgtataaatgcaggtcaatgctcatgttgagaattgacctgcatttttttgcgcaaaaggagaaatattatgcttgaaaaatattggataaaatgtccaatttgtaacggaaagacgagggttcaagtattttataatacggtattaagaaattttcctcttttctgccctaaatgtaaattaacgcatatcgttgatgttgaaaaactagaaatcataatcaaaaactctgaaaaacaaactttttaattttgaaaaggaaggatatttaaatgaaacacttacctaaaagtacacctacggaaatattgaatgacccatacggatttacttacaaagaaatgtcggaagtaattggagaggataaagcaagagccttatatacggaattgtataaacagccatttcacaaagaaaatctatcaatatcaacaaaaaaagtctataaaagtagcgatactgaaaagtatgtttatgaattgaaagataacaggtatattgaaacggtttttattaaacggcgagatggtgggactgtttgcgtaagtacgcaagttggttgttctgttggctgtattttttgtgagtccggacgcaatggttttgttcgtaatctaacaccgtctgaaattgtgcagcaggttgtattgatacgtcaaaaagtaaatcgtatcgtttttatgggaatgggagaacctttattcaattacgacaacttgattgcagcaatccatattcttcgagatagaaatggacttaactttccaaccgacggcattaccgtatcaacagttggtccagttaatcaattaaaaaaattgcgcgaagaacatctaaaaattcagttgacaatatctttacatgcagcaacacaggctgcgagaaactgtatcattcctcatatgcacatgtacgctattgaagatgttgttaagcaagcattgtcctattctcaaaggcataatcgaaaagtggtatttgcgtatttgcttttaccaggtataaatgaccgttcctcagatataaggcaacttgcaaaatggtttaagggcaaaaatgttatgattaacgtgctgcaatacaacccgacgagtaattcaaaaattagagcaccacaaaaacaagaaatggttgcgttcaaacatcaattagagcaaacaggacttgaagttaccatgagagtttctcatggtagagagattaaagcagcttgtggacagttagctaatacatataataaagccaaaaaacaacagaaataatttaattaaaagagccagacgcacagacgcagagccgataatatgcagtttgaaatactgctgttatcggctcttttttgattttaatttgtgcccctaataaccatattggagcaaaatcagaactgttgcttgtcgttctttgatttccgcagcagctttgaaaaatcaaagccgccgtttctttttatcttctaatgaaatgacgcggtatcactgttgaaatcggcggctaaaggaggtagccgccatgaagcaaaaagcatatcgacaaaatccgacagttattgacttatcaaaaaaagcccgcccaccaccgggggaaactacgcttatatatatgaactgtctaatcatctggatactgcttacaatgcctatgcgcccgtccgggcttttcggacgggcgcattttgtacgttcaaaaaatttttgaagaaatttcaaaaaatcttcggcgtttttgaaaaacgccgtattgccccgcgaaaaggggggaagcaccaccaactttccaacgagaaaggaggtgagaatgtggaacctaatagcagggagttttacaaacagtgtgcttttcagaagttttgtaatacggtattgcacaatgaagcttgcgacacccatagagaacttcgcagacacaaggcaaaggaagtgaccttttccgacatgaccttagacgaagcgcggcagcttcatacgtttgatgaatatttcaaacgtgaagccgccgaaaccgtctttgagaaagccgggaagaaaatcacgccaaagctgcttcttgaagcaatccgtactttgccggaagaaaagcgcaaagccatattgctgtattacttcgagggaatgaacgataccgagattgcggagctgttcaacacgtcgagaagcacgatacagtacaggcggacaagctcttttgagaaattaagaaaatatctggaggaaaatgctgatgaatgggacgaatggtaacgaacccggctacccggaaaatgcccttgttccttatcctgtcattgtggcagcgacaaagggcgacccggacgccatgaagattgtcttgcagcatttcagcggctacatagcccgcctctccatgcggaagctgtacgacgagcgcgggaacgtctattttggcgtagaccacgacattcgggaacggctgcaagcaaaactgatgatggctgtcctcacctttaaggcagaggaataaaccgcagcggcggcgggacgctttctctctcccccttttccgttccgctgctgacgcggcagcaaagccattctgaaccttgacaaagaaagcggcgcaagataacggcggcgcagcatagggcaaatcggatacgttccttttgcgccgagccatacggcgggtgcgccatgacgctatccgggtgaggttatccccgcccggacagccgagcgaccaacaccgcgccggaaagcaagtgtagcggcttgcgggcgacgacacgcagaatatacaatgatacttccttacagccacagtccgagcgttaagagcgtcgcaggcaatgggtagggcggcatgagaaccatgccggggtgaaattcccatgaggttatgctaataaccgtccgattaaagcctttgttttattgaatagtggacttgctgctattcatagactatattatatgtttgcgaaagaaagggggattttctttgacgcaaaaccaaacgcccgttaccacaacggagcataaaataggaaaagttacttaccttgtatgttcgtccgcaagtgaacgcgcaacggacacactggataaaaagataaaaaaactcattcgcaaagacatggaactgaaccccgcaaacgcccggaaatagggcgtttcttcacattttatacatgacacaggcagcggtatgtggtataatatagacagtacaaataccatgcttgtctgtcgtcggaaaggaggacaaaatgttacagacagacaagattaccgctttatattgcagattgagccaggaagatatgcaagccggggaaagcgagagcatacagaaccaaaaactgattttacaaaagtatgctgacgaacaccactttttcaacacgcgctttttcgtagacgacggattttccggcgtgagctttgagcgtgaggggcttcaagccatgctgcatgaggttgaagccgggaacgtggcgaccgtcataacaaaagacctttcccgtctgggacgtaattatctgaaaaccggggagctgatagagattgtctttcccgaatatgaagtgcgctacattgccattaacgacggtgtagacacagcaagggaagataacgagtttacccctctgcggaactggttcaacgagttttacgcccgcgacacctcaaagaaaatccgggctgtcaaacaggcaaaggcgcagaaaggcgagcgcgtcaacggcgaagctccttacggctaccttatcgacccggataaccgcaatcatctgatacccgacccggaaacggcgcacgtcgtaaaacagatttttgcaatgtatgtacggggcgaccgtatgtgtgaaatccagaactggctgcgggacaatgaaatactgaccgtcggggaactgcgctaccgcaggacagggagcaaacgccacccccgcccacagctcaacgcatggtacaactggccggataagacgctgtacgacattctgacaaggaaagaatatttagggcataccataaccgggaaaacctacaaggtatcttataagtcgaaaaagacgaaaaagaacccggaggaaaaaaggtatttcttccccaacactcacgaacctttgattgatgaagaaacctttgaacttgcacagaagcggattgccacccggcaacgcccgacaaaggttgatgaaattgacctgttttccgggctgctcttttgcggggactgcggctacaaaatgtatgcagtacgcggagccgggacgcttgaacggaaacacgcctacacttgcggcaactaccgcaaccgggcaagaaatgatatgctctgcactacgcattatatccgcaaaagcgtattgaaagaacttgtccttgcagacttgcagcgagtaacgtcttatgtgaaagagcatgaacaggagtttatcgaaacagccaacgagtgcagcgcaaaggcagtacaaaagacgctgacacagcagcggaaagagcttgacaaggcgcagaaccgtattaacgagctgaacatcttattccgcaagctctacgaggacaacgctttagggaaactttcagatgaacaatttgcttttctgacttccggctatgatgaagaaaaaaagacgctgacccggaggattgcggagctgtcacaggaaatcgacaacgccaccgagcgcagcgcggacgtaaaaaggtttgtcgcactggtacgcagatacacagcgattgaagaactgacctacgaaaacgtccatgaatttattgaccgtattcttattcacgaactggataaggaaacgaacacccgcaaaatcgaaatcttttatagctttgtcggcagagttgatacaggtgacaagcctaccgaaagtatctcctatttcagacagataggagccgacgtaaagagttatgctatctaacatacatcaaaaagaggtaagataacaccctctgcaaaaaaggtatcgttatcttacctcaacaaacatagtataagtttaaccatcaacggggacccggttgatgccattgtgaaggataacctgacgcttctggattttcttcgtgaccagctgtttctgaccggcacgaaaaaggggtgtgaggaaggggagtgcggcgcctgtaccgtgatgctggacggcaggccggttaactcctgctgtaccctggccgtggagtgcgacggccatgagattattactgtggagggaattgccagggacgggatgcttcatcccattcagaagcagttcattgagaagtgggccatgcagtgcggctactgcaccccgggtatgattatgtccgccaaagcgcttctggatgtgaataagcatcccacggaactggaaatccgggaagccattgaaggcaatctgtgccgctgtaccggctatgcaaagattgtggaggcaatccaggcagccgctgcgcagatgaactgggaggaggaagcaaagaatgcataaagactgtgacaaacattattttaagaaaccggaattttaccgtcttaccggcgagaacaactatgtcagaattgacgctgaagacaaggtgacaggacacggccagtatgtgggtgacatcatgttccctgacatgcttaccggaaaaatggtcagaagcccttatgcttccgccagaatcctgtccattgacaccagcgaggcggagaagcttccgggtgtaaagtgcatcctcacagccaaggactttgagtggaagtccctggtgggaaacggggaatttgcagctgagttcgcggacaaggaagtattgtgttctgagaaggtgcgccaggtgggggacgatgtggcagccgtggcagctgtggatgaggaaacagcccagcgggccgtggagctgattaaggtggaataccaggtgcttgcgggggtgtttgacccctttgaggcaatggaggaggatgcccctgaggtaaactgggagggcaaaggcatacacaatatcggcatgcagtccgtgatgaaggcgggtacggatattgatgaggaatttgaccatgcatcctatgtgcagcacagggattacaagacccaccgtatggtgcatgcggccatggagccccacggcgcagtggcaacctacaggaatggaacctacaccatctggatgtccacccagatgtcctttgtggaccagttctggtatgcccgctgcctgggcgtgggcgagaaccaggtgcgggtaatcaagccccttgtgggcggaggattcggcggcaagctggattcctattcctttggcctgtgcgctgccaagatggcggagctgaccggacgcccggtgcgcatgattctgtcccgtgaggaagtgttccagaccacacgcaaccgccatcccatttacatgcatatagatactgcctttgggacagacggcaggctgctggcaaaaaaatgctaccatgtgctggacggcggcccctacggggggtccggtgttgcggcctgcgcccagtccacattgtgggccaacttcccttacaagatgaattccgtggatttcctggcaaggcgtgtgtataccaataacccttctgcaggagccatgagaggatacacggcctgccaggtgcattttgcccatgacctgaacatgcagttcgcggcagaccagatgggcattgacccggttgagttccgtaagataagcgcggcagaccccggatacgtggctccggccgggctggcaatcaccagctgcgcatacaaggagacgctggatacggcggcaaaggaaattggctggtatgagaagaaggataagctgaaaaagggtgaaggcattggttttgcgggtaccggctttgtatcaggcaccggattcgcggtgctggaagcgcctaaccagagctctgcgtgtgtgaccctgcgcatgaacaagcggggcatggccaccctttatatcggctcccacgacatcggccagggttccgatacggtcatgacagcgattgtggccgaggagctggggcttcccatggacatggtcaaaacttttatgtccgacaccttcctgacgccatgggattccggctcttacggcagccgtgttacctttctggccggcaatgcggcccgccgcgctgccgtggatgcaaaacaccagctgtttgaggttattgctcccatgtggggcgtgatgccggagacgctggagtgtctggacggaaaggtaatcagcaaggagaaggctgaataccagatgtccatcggcgacgccatgttcaagtatatgacggtcaagggcggtgatgagctcattggcgtgggctcctactaccaccgtaccgacaactcacagtacaacggcaacaataccaccaactatgcgcctgcatacagcttctccaccggagcagcccatctgacggtggacgaggagactggcgtcctggatattgatgaatttgtatttgcccatgactgcggccgagccctgaataagagggccgtggaaggccagctggagggctccatcggcatgggcctcggctatgctgtctatgagcacaatgtaaccaaggaaggaaagattctcaatcccaacttccgcgactaccggctgcccactgcccttgacatgccaaagatgcgcaccttctacgactttacaccggacgaggaaggaccgctgggtgcaaaggaagcaggagagggctccgctgcgcctgtggctcctgccattgccaatgcggtcaacatggcaaccggcgtgtatttcacagagctgcccctggacccggagcatatctggagagcgctgcacggcatgaaggatgacaggaattcaaaataaaggcaggtcagggaatcgcttgatgaaaccaggaaggcggcttcacgccgccttctttcaaccggaaaggaggcagtcatatatgggccgccaattaaagaaaatgcgcctgccaaacggcgtggaagcagaggaaaaggcctgcggcgattatgtctgtaagtattgcgggggcaaggccactgcctgtaattttgtggctggtatgtgccttcaggtatatgcccgccatcagggcatgtgcggggcttatattgagagtgagaaatatgtgggctatgtcacggattgcagcacctgccgctgccagggcgtatccggggaatgcagatttgagggcagggctgccatggggcaggtagtatgactgaatggaaatggagataaaaaaggaaaaaggggcatccgcgcatgggtcagtcgctatgggggatgtccctttttattatgatattttactaaaactgattctggggtgaatgaggggatttaagttcacccacagcctgttttgcaatcctgatggctgcctttgtcacgaaaaaggcgaatacatagctgatgataaacatgatgggccagtcgtgaagcacgccctgcagaaatacggtccgggtgtccggaaggaagccggctgccacagcagcctcaatttccggattgtgaaagacattgaccgctgtgaggacgatggtggccgcggtgttaaagaacagggtggccacaaagttttccacaagcacatggggcagggtttcgggcctgagtcccattttcctgccaagggcaaatgaccagtccgtcagaggaaaggccattccggtcaatgaaatcaccagaaaagccgtgccccagttcctgatgagcaggggtaccgtaaaggtgagtctgtcaacaaagattgccgatgcggccataatcagggagatacagatagccacaacagaagatataatcataccaaaatgatttttgtaaaagttcataaaatacgccctttctggtctttaatacaaagcatggcgtatcctgggagattcgccattcaatttctctacaaccagggttggataaccggtgtacggctgcacaggctgacagcgttgtaccggctgcttgattacagccccgaagaatttattttttcccatccctccttgtctgtacgctgcttgcgtattccccaatacagatgcatgcgtttttggcggcgggcagttatgcgcccttttccatcctcaaaaccgcggggcgaaagccggagcgtgccgtttaagagtaatttaagacacgcagcaggagaacgtaatggtttggcttttttgcctgcggctgctgccgttcccggattccatacgtccggaatccggaagttgattgtttgttctatgatttcccatcctacggatgtacaatcatcactgtgccgtctaagtccccaaccggaagcataagcagtgcgccgtatctggcttccaggtcctccactgcttttgcaacgcccctgtaccgggtgtcgctgcatccgctcaggaggatgactccgcctctgcccatgcggggaaagaaaaattccagaccggccagagtgggctggtacaggcaggcatccatgcagacaaggcagaatttttcatcttcaatgtcaaaggcggtttcaggaaaccatcccttccggatgacaacctgtccgggcaggggcatccgttccatcagtttttccctgtctgtcccggaatacaggcccgctattgcgtcggaacatcccagttcccgttccctggcaacatcccgttcatcgaaaccctcaaaggtgtcaaaaagatacagcttccggtccggcatcagcacgttgagctgccaggaggtgccgccttggtaacaacccagctccgccacatttccctccacccccagtccggtgagacgccggcacagacggcgcaggacgctgcaccggatagagaactgctcatacaggttccggataaatacaatgtcgttcaggaagccggcgcggatggccatgtattccagggcatggcttttttcggcatccgtggcggcgatgaccaggacgtccggctgaagggcaaccgccaggtctaccggcataattggcattccttctatttcctccttcagttccccttgttccaggtctgaaaatacattccaggtctccggcctggtgtcccccagaccgaccagcttcatttcatgtggatttagcatatccgccacagccattcccagactgtcggcgcccagaataacaactgtcttcatgagccctcccccttattcccttatcatactgtctgcagacattgtaggacaggaatgcagcagacacaagtagcccaggtcacatgtgatgccaaattacaattgctgcctgccatccagctgttatatgccatacttaaaatggagggttctgctaatcccggggctttacaataaccgcgctgccatgaaggtcgcataagggaacaaggcacaggcggctgtattgtttttcatattcatccacagcctgcccggctccgcggaaccgttcattgttgtaatcgtggagcagaatcatgcctccgggtacaagacgggggtagaagaatataaggccggccagaatgggagcatacaggtcggcatccaggcttaccagggaaaagcgctcctgttccagacctgccgctgtatccggaaaatatcccctgcgcatgacggcccggtcaggaaaggggagccgtcccagcactgcctgctcgctggtgtcagagaattccccttccctggcaaaggaacaccccatatttttttcttcttttatatcccttgcgtcaaatccctggaatgtatcaaataaataaagcctttgctgcggaaacagggcgttgagcttccaggccgtatcgcccttaaagacgcccagttccgctatgcttccctggaggccctgtccatgaatccgctcagccagccgtttcagggtggcgcttcgtatgtcaaaataccggtaaagctggctcagcatcagaaatctgccctcatatcctgattccagggcctgttccttaagctggccggaacgcagcgggtccgtcacaccgataatgacataatcaggtttcagcaagagggctttttctaccggtaaaattgggatattggctggaaatcctttttctgtccgttctggttcggtcagccggtgcagtgcagggttattatccccaaaggccagaagggccatgttttcctgattcagcagtctggcagcgccgcggccaaactggcccgcgcccaggatgatgacagtttccatatagttccaatcctcctatcatataatgatgcagtcctgttaatcccatcccatacattgtatcacggaaccgtaatctgtggatagttaccgctgcaatatatatgacacttacatcacatgtaaaaatttgatataatgtagtataagctactagttgttaaaatactaacagtgttataattttgttaaaggacacaggcgtttttggggattcatatggtgaaaagccataaaagagagggtggttatatggtgggtcaggagtgtaataccgcagtacagatgccgcatgctaattttgtatcacgtcttctatatctgcccaggggaatatcacggctggaaaagctgggacagagaaaggtatttccaaagaaccacatgctggtgcaggcaggtacaatgcccaactattgctacatagtcaagaccggacgggtggcggcgtttgagacaacggttacaggcgaggagcgcatttataatttcaatgagagcaattccgtcctgctggaaggaaaccttctcttaaatcaggaatcggctgtgaatttcaagaccgtgcagccctctgaattagtctgtatcaccagggagatgctgctgcagggcattgcccatgacccgcagctttccatggatattatggagtccctatccaccaagtttctgtcggccatggaacaggtgcgccataccaatttccacaacgccggctggaagatttgcgacctgctgcttatatttgcagagcattacggggttccctatgacgggaaaatacttatcaaagaaaagataagccagcagctcctgtcaaatccgctgggcattaaccgggtaactgcggtcagggccattaaggagctgaaggagatggcgctgatagagcagattaacggatactactgcatccgcagcctggagaaactgaaacggcaccaggagaggatgtgccagtaggaaaatgaatgaaaaacacggaaccggagtaaaatctgattccgtgttttttgatgcacatgcatagggtgtatcctgcactactggaatcctgtattccggccggatataatacctgtaaggcaacttattaagacggtctttgcaggaaagaggcgggaatcatgaagaacacaggagctgtcctggcagcggcaggactgtcctcgcgcatgggggatttcaaacccctgctgccctttggggactctaccatagcatttcatatcacgtccatgctcaggaggctgggggcggacccggtcatcgtggtcacaggctacagggcagaagagctggaggaccacctgaaaggcacgggcgcctgttttgtcaggaataccggataccgttacacacagatgtttgattccgtgaagctgggaattcaggctgcactggaagggtgtgaccgaatcatggtcatgcccatggaccttccggccataacggatgataccataaagcgggtgatggaggcttccgggcagattgtgcgcacggtccatgacggtgaaccggggcatcccatatgcctggacgggcagattgccaggcgcatctgcacctacaccggggaccagggacttaagggggccattgaagcatccggcgtgcctgtggaggacctggaagccggagatgagagtatatacctggatgtggacacaaaggaagagtacagggagctgctccgctgggtttgcaaacaggaaataagccgaagaaaatgtaagaggcattgaggcgctttatatttacagccatccgccgtatgtggtatactcaaatcaacgttgtttatgggattaaataacgctgtttgaagaatatggcctttctggctgcctcatattgtaatttaaatgcttctgtgttacactggaactataaactaggtcggacgacctattcggtatcggcaatgcatggaaacgaggtggcatatgaggacgatatacctgataaggcatggggaaccggaacgcaccggacatgtaagcagatgtcttggacacacagatgttgcactgagcatcagaggcaggaaggagagtatggagctggctgactggttcagaagccgtcctgtggaggctgtttatgcaagccctctttccaggtgcatggaaacggcggagtacattgccggagagcatcagaaggttcggcaggaccagggactggtggagctggacgcaggtgaatgggagaatatggattttactgaaatccgcagccggtatcctgaactctatgaagagaggggacgttccatgggcacggttccgcctccgggaggagaatcctttgcccagggaggaaaacggcttgaagctgccctgaaccgcattctggaaaagacccggggggatgtggctgtggtgacccactgcggcgtgagccgcggcctgctgtgcggtattctgggctgggatattaaccgtgtgctggaagttccccagccatacgggggtatcagccggattctggttgacggggacggcggtttcaggggattttatgagcagaccggggtaaagccccttctctatcctgaccacggcatctgccgcagactgtcggaccgttacggtgttccggagcatatccggcttcatgaggctgccgtggcaaggctggcacatcagtgggctgtcaggctgggagcgctgggttatgacatagacccggagcttctgaggacagccgggctgcttcacgatattgcgcgtcttcagccggaccatgcaagggcaggggctgaggtcctgcgaaaggaaggatacccggtgatggccagaatcatcaagagccatcacaggctggagggcggggaagagtgcagactgacggagagctcccttttgttcctggcggataagatgatgctggaggacaggatggtggatatcgaccaacgtttccggcagagcgcgcccaaatgcaccactccccaggccagagagaaccatagacttcaatataatcaggctcaggcagtcagacattgcctggaaacagccctgggaggcctaaaggcagcggatgcttttagagccagtccccaggcgtctgtgggcatgaaggtccggatacgggaatgggctgccggctgagcataaggagatgaagtcacatggaaggaaataattcaaccaagaccaaactgattaaagctggtattaagcttttttcacagtatggatatgcagccacatccaccaggatgattgcttcggaggcagaggtaaacctgtcggccattgcatttcatttttccaacaaggagaggctttacgtggcatgcctggaatatatgctggaaaaggtaaagagctattatgaggcgtcctacatggagattgagggaacctttgagcagaacgccatgacgcccgggaaggcctatgaatttcttgaaaaactgatagaccttcagatagaggtggcctttgcgccccagtataagaccacccttgccctgatatactgggagaacaacggccccggggatatgaggcctttgtcggctgctgcctttgaccggcaggaacgggtgatggcagagctgattcagaccgttgcccctgtttccacggcccaggcagtcatagccagcagacatatcaacggctccatcatatcctttggcgagcaccgcggattcatagaggacctgattccggaacccctggagggggagcccgtgcccttctggatacgtgaggagataaaaggaaattgtatggccattgtagagcggctgacgaagccggagctgtttccgccccatctgactatatgacggcatcccggtttttggcggattctggggaaaatagagtataaggccaaaatggtacttggacgatattcacaaacgagaataaccctttgaggtgcattgtgcacaacctcgaagggttattttaggtcctgatatataaaaaatgcacaaataaataaattgatatttatatatcattgacaaaagtgtctcattgtgataaaaataaatcaaacgaccgacctagattagcacaatcttaacaaatatatcccattcacttaatccagataaggaggcaaggaaacgttatgaagaaacagtatgttactctgacggtaaacgggagggaatatcgtttctcaatcggggacggattcggacaggttcccccctcagagacactatcccagaccctgcgaaagaggctccagctgaccggctccaaggagtcatgcagtgagggggcctgcgggtgctgcaccgtgctcatggacggaaagggggtcacgtcctgtatgctgctgaccgtggattgcgacggaaaggacattgttaccatagaaggactggaggaccctgagaagggactggacccgctgcagcaggcgttcattgacgagtacgcatttcagtgcggttactgcacgccgggaatcatcatggctgccaaggccctgctgctggataatccccatcccacgggagatgaaatcaaggaagccatgtcaggcaattactgccgctgtatcagtcattacacggtactgcgggccattaacagggtggcggggaacgaggaagaccatctggccgtgatgcacagggccaatgatgatgtggaaaatcccattccggtacgccaggaactgttcttaagtccctatgccaatggtacaaacagcgaccattcattggattagaaggagggtattgaagaatgagcaagcttgaatatcgcgatatcaaacagcccaattaccgccatgtgggcaagtacacacccagaaaagacgcaaaggacattgtgacgggaaaggctattttcctggatgatttttcagtgcctcacatgctgtacggaaagacaaagagaagtccttatccccatgccagaatcctttccatcgacacatccagggcagaagccctgccgggtgtaagggctgtcattacccataagaacatgccggagcggtgggggctgggccttcctgtgcacaggcttctgatggaggacaaggtttactatgtaggagatttggtggccctgattgcagccgacacagtggagattgcagaggaggccatagaccttatcgacgtggaataccaacagctggaagccgtgtatacggctgaggacgccctgaaggaaggggcggtggagatatatcccaggtttaaagggaaccatgtggacaacggtatcaagtatttccagcccgacggtccctggtggcagattatccgaggggatgtggaaaagggattcgaggaagccgcctatgtggcggaagataaggtggcatttgacaagatgccctcccctctggccccggaaaccccgtcctgcatcgccaaatacgagggcgggaatgaatataccatatgggcttcatcccagagctcccatatccttaagctcatgggcgagggaagaattcccaattccaacctgagcgtaaagacctttaacgtgggaggcagctacggcaacaagcagtcccttatgacaaccgtgctctctgcctccatgctgtccctggttaccaagcagccggtaaaaatcgtgctcacaaaggcggagcagctcatggcctacgaggtgcgtctgggcagcaccattaccgctaaggtgggaatggacaaggagggctatgtaagggccgtggaaggcgactggctggtggatacgggagccatagcagactccgtacagggccaggtgggcgtgggccttggcgaggcgcagctggtgtgcgccaaatgtcccaactggtatatggacagccatattgcagtgaccaacaagcaggcggcaggtattgtacgaggctacggcggccaggagctgaacagctgtctggagcgtctgatgtgcgccgtgatgaagaagggcaattttgaccccctggatgtgttcaagaaaaattatattgcgcccggggaccggttcatctggcgggacggacggtggtggcagagccgttcctccctgttcttcccggaagcaatgcagaatgcggcggaccgctttggctgggccgataaatggaagggctggaatgtgcccacatgcgtcaacggcacaaaggccaggggaatcggcatgggcgtaatcggaaatgccgacatcagcgaggacaacacggaggccattgtcaggattgttccggatttggttggaagccgcagggcgtccacagccattattgagtgcgatatcacggagtccggcatgggaaccagaagcaatgcgtgtaagattgtggccgaggttcttaacgtacccgtggaaaaggtgtccatcacggagccaggctccaagttcaatccgtccaactacggtctgtgcggttccagaggtaccatcaccacaggcaaggcagtatccctggcagccatggaggcaaagaaaaaagctctggagctgggcgccctctactttaagcgttccgtggaccagctggacacaaaggactttatggtctatgtgcgggataacccggaattggtggtgcctatgtttaagctggctcccaaggagctcagcattgtgggatatggaaagcacatggaaatgttcaatatccccagctgcatggccatattcgtggaggcagaggtggacctggaaacaggcaataccaagctggtgaaggtggccggaggtacggacatcggccagattattgattccaaggcagtggagatgcagctgcacggaggcttcggctcagcctgtatcgatacagccatatttgaggagtgtatcctggacccgtccacaggaaggcttttaacctccagcctcattgattataagtggaggacattcaatgaattcccgccatatgacgcctatatcatggaatcccagattgattccttcatgtttaaggccctgggaattggcgagatttccggtgcggcaggagcaagcgcggtgctgatggccatatccaatgcaatcggcgtggacatcaaggattatccggcaactccggcagttatacttaaggcgttaggcaaagcataagaggggaggattcactgtgaaatattttgaacatgagagcgctgccacctttgatgaggcagtctccttattaaaagagtccccaaaagggaaaaccgtagtaatggccggaggttccgacctggttggagtattgaaggaacagattctggaggagtacccggaaaaggtggttgaccttaagaccgttgaaggcggggaatacataaagcaggacggggatatgattgaaatcggcgccctgacaaagctctgcgacatcgtgaagtcggaccttctgaatgaaaaggcgcctgtcctttcacaggcagcccgttccgtggcaacaccgctgattcgcaatgtggccaccatcggaggcaatatatgccaggatgtgcgctgctggttttaccgctatccccacggcatcggcggcaggatggactgtatgagaaaaggcggaaacgaatgctatgcagtcatgggggataaccgctaccattccatattcggcggcatgaaggtccacaccaccccgtgctctgttaagtgtccggccaatacggacatacccgcctatatggaccggctgcgggagggggatacagagggagccgcccgcatcctgatggaagccaatcccatccccatgattacatccagggtctgcgcgcatacctgccaggagcagtgcaaccgctgcgactttgacgagagcgtatccattcatggcgtggagcgctatgtgggggattatatactggagcacgcggatttgttctacagggcgccggaaaccgagacaggccataaggtggctcttgtgggagcaggcccggcaggcttaagcgccgcctattacctgaggaaggcgggccatgacgtgacggtcttcgacaagatggaggaaccgggcggcatgctgacctatgccattcccaactacagactgcccaagtcctatgtgaaacaggtggctgcggcctatgagaagatgggtatccatttccgtctggggtgctgtctgggtgaggatgtgcaggccggggaactggaacagcagtatgacaatgtgttctatgcaaccggcgcatggaaacgccctgtgctgggatttgacggcgaggagtttacggagttcggacttcagttcctgatggaagtcaaccagtggatgaacaaaaaggaccgccgccatgttctggtggtgggaggcggaaacgtggcaatggatgtggccattaccgccaggcgcctgggcgcggagagcgttacgctggcttgtctggaatccgagcctgagatgccggccagcagggaagagattgcaagggccagggaggaaggcattgaaatcatgccgtcctacggcgtgtcaagggcaatctacgaaggcgataaggttaccggtatggaacttatgcgctgcacctctgtgaaggatgagcagggacattttaacccccagtacaacagggaggagacactgattgtatcggcggattccattctgatggcggcgggacagaaggtggacttaagtttcctgggagataaatacggtcttgccctggagcgcggactgattcaggtggacaaggatacgcaggccacaagcaagaccggggtctatgcaggaggcgacgccaccacaggaccggcaaccgttatccaggcagtccgttccgggcgcaatgccgcggaagccattaacaaaggctacggcatcatgccggagcgccgcagggaggagaagtttatccactttgacgctgcaggcgtaaaggaagagcatgcggtaaaggataaggagctgtcagcccaggaacgggctctggataaggaggacagcttcacgctgaccggagaggaggcagccagggaggcaggaagatgcatgaactgcggatgctactccgtcaatgcttcagacatatccccggtgcttatcctgctggacgcccagattgtgaccacaaagaaaacagtgagggcggctgactttttcaccacccatctgaaagcagtggatatgctggatgcggacgaactggtgacagctgtccggtttaagattccggaaggctataccacggcctatgacaaattcagggtgcgtgaggcagtggattttgccattgtcagcctggcttatgcttacaggatgaaggacggcgttatagaggatgcgagaatcgttctgggcggcgtggccccggtgcccatggaacggaaaaaggtggaagcattcctgaccggcagaaagccggaggaaggcatggcggaatccgccgcggacctggcagtggaggggaccacggccatggccaacaatacatataagattcaggaggtaagggctcttataaagaagatgattatggacatgggggctatccaggcataacagcccgctgcatcaatgactgtatatttatggtttcgccttcccggggtgtgttttcagatacgctccggcggggtgaagccgtaaatacgtttttcttgaaaatgttaaaaaaataacaaataatggcaggtcttttaagtacaaggaagaaggtattttatggatttgatgaaaaaaaggtgggcggttctgattgccagtgttattgttaatatatgtattggtacggggtttgcatggagtgtttaccagacagggctgtttaatgagggggcagtgatattcggggcagaggtacagaagtcacagctggctttggcctttacaatctgcagcggcgttgcgccgattcccatgattgcgggaaatgggcttcaaaagaagcttaaggggccaaggaacgtggtatggctggggggaatcctgttcagcgcaggactgatttgcaccagcttcatccacagccttaccatgctgtacgtgacatacggacttctctgcggctttggcatcgcctttgcctacggcattaccattggaaacacggtgcggtttttcccggacaagcggggattgattgcaggtatttccacggctgcctacggggctggcagcattattttcccgccaatcatgcagtcgctgattgcttccggcggcgttatgtttaccttccgggtgctgggaatcctgtttggggtaatgataatcatagccgcctgttttatcaccgaacctcccgagggatggctgccaaaggggtgggcgccgccggcggccaaaaacagttcctctttagcggctgacggaaagaactggaagctgatgctggctgacggaaggttttatctgatgattattgcatttaccatatttgccacaggaggacttatggtggtgagccagggctcgcccatggcccaggccatagccggggtggacgcggcagttgcagcaaccgcggtcagcatcattggcctggccaacacgggaggcagggtgctctggggatgggtttccgataaggtgggaagatatccggccctcagcatcatggccgtcattgtggcggtaagcggttttgccctgtccgcttgtacggacagcggttcactggtcctgttccttgcatttgccatgctgattgccatgtgctacggcggaagcatgggcgtatatccggccctgacggccgatgccttcggaatcaggtataacggggtcaattacggcattatgtttatcggatttgcgcttggcggttacatagggccgattctggccaacagtctctacgacagcaccggttcatacggcgtgccgctgatggcagtgggcgcaatgggcgtggtggcgctgattatattgtttgttctgacagctatcaataaacgggcacagagataggggaaggttcgatggaagacctgattgacggaaagagaagaatacaagcagtggtttgcaggggtgagaatggtcccggggacgcctcctttctctttgacagggctggccgcctgctggcttttgaggggaccatgtccggttcagaggctttcggggaaatgctttcgcagatgtgcaggaaccagcccggaatatccggccgggagggtttggaaaccgagtgggaaggcgcggcgtatcatgtctgtctcaaccggtacattcacctgaccctgggtgagctggcagatatacaggcgcagcgctttcctgacagggaggctgtggttgacagcctggcagatgtgcgccttaccttccgggaggtcaaaaagcgcagcgacagtctggccaaggggctgattcacataggtatctgcaaaggggaccatgtggcggtcatcatggataactgctgggaaaatgtaatcacaaaaatagcgattgaaaaaaccggggcagtgatagtaaacctgaatattcacgaaaaaagggacatgctggaatgtctgctccaccggacggatgtgaaggcggtcatactgaagcagggaatcaaaaaccgggagcacatggacatattttaccaaatcagcccggagcttaaaacagcggttcctggaaggctctatgtgccccgcctgcccaggctgcgccatatagttgtcacggacccgctaagacccagaagctgcgcctggcagtttgaggcgctgatggaacagggaatgcggatggatgacgtgattttggaggagaggatgagggaaatcagtccctttgacgacgccaccatcatccatacctctggtaccagcggcgtgcccaagggagtggtgctgtgccactgccaggtcctggaaaatgcatggagccatgtacagtatctgggactggagaaagaggaccgcctgtgcatgacgcctcccatgttccactcctttggatgcgtgggctcggtgctcagcgccatgatggcaggtgcagccctggtctgttatgagaagacggacagaatctgtctgctggacatgctgaggaaggaacggtgcaccgtactgtgcagcgtaccaacggtctatatccgcctcatcagggagatgagggagggaaaagcgggcagtaagaatttatgcctgcgcctgtgcgttacggccggagcgccctgtccggaatataccttgagggacatgaaacatgttataggggcaaaagccgcggtggtcatgtacggcatgacagaggccggaccgggaatcagcagcacaaccatggacgacagcccggaggtgacggtttccactgtgggcaggctgtggccgggggttgcggggcagatacgggatttaaccacgggccgggtgctggggcctgggcagaccggtgaactgtgcatcaggggctacggcgtgatgaagggatattacaacaatccggaggaaacagccaaagcagtggaccgggagggctggcttcacacaggagacattggtgccctgtcggaggacgggcttctgaccctgaagggaaggtgcaaggatttaatcatacggggcggggaaaacataagccccaaggaaatagaagattttatacggaattatgaacctgtggaggaagtggctgtgtgggggcgccggatgaacagtacggcgagctggtatacgcctttatccgtctaaaggaagggactgtgattacaaaggagggcctgagggactggtgcaggggtagaatcgccaccattaagattccgcaggagatagaactgacagaccatttcccggtaacagctaccgggaaaatattaaaaggacgtctgcggagccttgccagggagcatctggaggaaagggcgccgaagcggacggatgcggaaccaggcgggccggaacggacggatatgaaagcgggcgaagaagggcggatgcccatggagacgggaaaggacggtatggataaatggcaaaaatcataacagttaaagaggctgcagagctggttcaggacggcgcggtgattggctcggcagtacagggaatgacaggctggcctgaggaaatagggctggcaattgagcaacggttcatggaaacagggcacccatcggacatcacccatatccatggggccggccagggggatttcggacggatgtccgaggacggaaagacctgccggggagagtgcgccctggcccatgacggactgctttcctgcagcatacacggtcatgtgggatgttcctttaaggtgacaaagcagatagtggacaataagattctggcctacaacattcctctgggagtggtgggacagatttggagggagatgggacgcggattcccgggccttatgacaaaggtgggactgggcaccttcatggaccccagatacgacggggccatgattaacgagaagacaaaaaaggaaggtaagcagattgttacatacattcctgatttccttggggaagagtatctgttttatacattgccaaagctgacaatagccctgctgcgggccactacggcggatgaggacggcaatctgacctatgaaaaggaatgcatgccctgtgaacccctggacctggcaatggctgccaaggcagcgggagccattgtcattgcacaggtggaacgggtggccgccacagggaccctggaccccaggaatgtgaaggtgccggggattctggtggattatgtatgcgttgcagagcatccggagcgcattatgcagacccacatcactcattttaatcctgcttttaccggagaaatccgcatccccatgaagaacagctctgccccgttgccactggatgacaagaaggtgtttacaaggcgcactgccatggaaatccatgcaggggacaagtgtaatctgggtatcggaatgcccgggctggttcccaatgtgctcatggaggagggcgtggattcacaggtgaccctcatatcagagtccggcctcataggaggaatccctgcgccgggaggcgatttcggtgcccatttcaatccggtggcaatgtatccccagacagaccatttcagtttctttgaccagggcggtctggatgtggctgtgttcggcctcagcgaggtggacagggacggcaatgtgaacaccaccttcctcaatggaaagatagccggagtgggcgggttccccaatatatccgccaatgcaaaacattccatctttgtgggctcctttacggccggagggctgaaatgccatattgaggacggtaagatgtgcattgaccaggagggacgtttcgacaagttcgtggaatcctgcgcacagctttcctttaatgcggagcagtgtctggcaaagggaaaccgggttacgttcatcacggagcggtgtgtgattaagagaaccccggagggcatggtgctggccgaggtggccccgggtattgatatacagacacagatattggaccacatgggcttcgcgcccattatacctgagggagggcctgctctcatggacgcaggactgttctgcgagacatggggacgcctgggagaccatttttagaaaaaagaggtaatatatgagaaggatggaatcagataactgctttgtctgcggcgccctgaatcccataggactgcacctggacattacggaaggggaaggctgggccagggcggcctggaccgtggaaaagccttatgtgggatatgaaggaatgcttcatgggggcatcatggcttccattatggatgaccttatggcccatgccctctactatacggacctggatgtggttacggcccatctggagctggattacaaggctccaatctatgtgggggagcggattgagtgcgaggcccgggtgacagagttcggtaaggggcgctccatccgtgcccagggcaccatcagccgggacggcgaagtggccgccctggcaaagggagtcatggtaattgtgaaggaaccggggaccaaggcagggctgtgacctgattaggaggtgtatcatggagagaaccggagcagtgatactggcggcagggctgtcatccagaatgcatgagtttaagccccttctggagctgggagacagcaccatgattgtcagggccattgagaatcttaagatagcaggggcatctccggtcatcatagtggccggatacaaagcagaccagctgatggattacctgtggcccctggatatcatgtttgtgcgcaatgaaaattatgcctccggccagatgtttgattcagtcaaactgggcatatcaagggccgcggatttgtgcggcagaatccttattacgcctgcggatgtccctctgattgggcagtatacctttaagcaggtgatggaatgtccgggggccctggtgcgcccggtctgtgacggccgtccgggccacccggttatggtggattcacggctggcgccggatatctgcgcctatcaggggggcggaggtcttaagggagccatggagaacctgggggtgccaatcacggaagtggaggtggaggaccccggaatctacctggatgcggatacgccccaggattatatgaatctcagatactggaatgattacagccaggtgcagaaacagggctctaaaatgatacatttccgtatatccataggaatgacctcatagggaataaaatggaaatggtcaggtgtgccgcagcaatggaacacctggccattttcctctgaatgcctgcatccgcacctgttttcccgcggtccggactgttacaataaattcgcatttgtagtgtatgtgtctttacaaaatcaaaagcaggtgttattctatatgtaatgcgttatttgaaaatataaataacgggcggaggttaaacagaatgaaactgatacagacagtggatgcggaaggcaccgtgctgtgccacgatatcacacaaatcatcaagggagtgacaaaggatgcggtattccgcaagggccatgtggtcaccagagaagatatcccggtcctcttaagcgtgggcaaggaccagctctatgtgtgggagaaggaagaaggaatgcttcatgaaaatgacgctgctgagattctctgtgatatgtgcagaggacagcatatggagcgttcccaggcaaaggaaggcaagattgaactgacagctgcatgcgacggattgctgaaggtggacaaccgggggcttaaggcggtaaacggattcggacagatgatgatagccacccgtcacggcaactttgcagtgaagaagggggacaagctggccgggaccagaatcatccctctggtgattgagaaagaaaagatggaggcagccagaacggcggctgcgcaggcaacagggggatgtcccatactggagctgaagccatttttacataagaaggtgggcattgttacaacgggcaacgaagtgttttacggacgtatcaaggataccttcacccctgtgatagaggggaagctttcagagtttgacacagaggtcatagaccatgtgacatggaacgacgacgataccaaggtgacggccagtatcctggacatgatagaaaagggcgcggatgtggtggtctgtacaggcggtatgagtgtggacccggacgacaagacaccccttgccatccggaacacaggagcccgcgttgtatcctacggcgcaccggtgcttccgggagccatgttcctgctggcctattaccaggtcagggatggggagaatccccgtaccgttgccattatgggacttccgggctgtgtcatgtatgcaaagcgcaccatatttgacctggttcttcccagaatcatggcagacgaccaggtgacggcggatgacctggctgcgctgggccagggcgggctctgccttaactgtccggaatgcaccttcccgaactgcggattcggcaagggactgtaacaaaggggttgaaaggaaacagacatggaatttacacattttgacgaccagggaaatgcccttatggtggatgtgggggataaggcggagacaaaacgggaggcagtggccaggggcagtattttcatgagcccggagtgcctggaaaaagtggcccagggaaccatggcaaaaggagatgtgctgggcgttgccagggtggcaggcattatgggagccaaaaaaacctctgagctgattccgctgtgccatatactgaaccttaccaagctcaccgtggattttaccattaagaaagagacaaatgagattgaggcagtctgtacggccaggaccacgggaaaaacaggagtggagatggaagccctgaccggggtgtccgtggcgctgctgaccgtctatgacatgtgcaaggctgtggataaggccatggaaatcggtgacatttacctggaacataagagcggaggcaagagcggggaattccataaccccagatgtgcccggaacaggggatgagcaatatgaaggatgcattgggaagaaccattgactatatgaggatatccattacggacaggtgcaacctgcgctgcaggtactgtatgccctatggtgtggagtgcgtgcccagatgggatatcctgaccctggaggagattcaggccgtggctatctgcgcagccggtctcggcatacgccatattaaggtgacgggaggagaacctctggtcagaagagactgctgccagctggtaaagcagcttaaaagcactccggggattgagaaggtaaccataaccaccaacggcgtgctgctggagcgttatctggatgatttggcggaggccgggatagacggcatcaacataagcctggataccctggacagggacctgtatcagagaataacggggaccgatgccctgggcactgtgatggagtccgtcaggcgggccagcgccatgcccatatctgttaaaatcaatgcggtatccattgatttcagccagatggaggaggactgcggggaatgtccggccggaaatcaggatggctggcagcagatggtggagctggcaagggagtatccggtggatgtgcggttcattgagatgatgcccattggatacggcaagaattttaagaccatcaaccaccgggaactgctggaggagatggtgaaagcatatccacgcatggaggaggatgaccaggtccatggtttcggaccggctgtctactaccggataccgggatttaagggcagcattggactaatcagcgcgattcacgggaaattctgcagtgactgcaaccgggtgcgcctgacctcccagggttatctgaaaccctgtctgtgctatgaggacggagcggatttaaggcggattctgagaaaaggacaggaacggccgcaagaggaggggcattaccgctggccctatgcaggctgtccgtcgaaccaggaacttcaggggaaactgagaaaggccatggaacaggccatattgtgcaaaccggcggcccattgctttgaacggccggggcagataacagaagcgcataacatgattgctattggaggataacgtatatgtcagagcaggcaaaacagagtgtctgtcccaccggagtggtgaaggctatctgtatcagtgataaaaggggaattgagaagcgggccattgaccagggccattttctggtggatttcggtattgagggagatgcccacgcaggccactggcaccgccaggtaagccttctctcttatgataaagtgaaggcattcaatgagcggggggccgatgtcatagacggggcctttggcgagaacctggtggtggagggcattgatttcagaagccttcctgtaggtaccaggctgtatgtggggacagtccagctggagatgacccagattgggaaggaatgtcacagccactgtgctatttacaagcgcatgggcgagtgcatcatgccgaaggagggcgtgtttgcaaaggttatcaaggaaggcatgatccgtcccggtgatgtgatgcgggtggagccgccggcagaggacaggccgttcactgccgcagtcattaccctgagcgacaagggcgccaggggagagcgcagggacgagagcggtccggctgcaaaggagctgctggaagcagccggttatgaggtagcggagcttctgcttctgccggatgagccggcccagctgaagacacagctcatccgtctggctgacagccgccaggttgatttggtgctgaccagcggcggaacaggcttttccctcagggaccagacgccggaggccaccatggctgtggctgagcgcaatgcacccggaatcgcggagttcatccgcatgaagtccatggaggttacggacagggccatgctcagcaggggcgtgtccgttatccggggaaggaccctgatagtgaatctgccggggagccccaaggcggtcagggaaagcctgggcttcatcatgaacagccttgaccacggccttaagatactcaggggaagcgcatcggaatgcgccggaaaccagtaatagaaatccggcagtcaaatcctaaaccggccgccaaggagaaatccggcagccaaataggagttcaacggtgatataaggatacaggtgcctgttcggtacaatgcccatccggtacagatgggcatttatgtggggaacgatatggtcacataagtataacgcatacctgtatctgtatatagaaattttaaatccaggaggatgaaattatgaaaaaacagctttgcatgatgatggcagcaatgctggcagcagctgcactggccggctgctctggcggggcaaaggaaacaacggcagccgccacggaaacggagacaacggcagcagaaactactgcggcaaagaaagatgcagagacagctgacggggaaaccacagcggcccaggcaggcgaatccacggagatactggttgcagcggcagccagccttaagaacgcctatgaggatgagctgattcccatgttccaggagcagtatccgggcgtggttgtaaagggcacctatgacagctcaggaaagcttcagacacagattgaggaaggtctggaggcagacgtgttcatgtcggccgcaaccaagcagatgacagccctggacgaggaaggcatgattgattccggcaccgtcaccaacctgctggagaacaagattgtgcttatcgttcccaccggcagcagcgcgggcattgagaagtttgaggatattgagaaggcggagagcattgcccttggcgaccctgccagcgtaccggccggacagtatgcacaagaggcccttaccagcctgggcatctgggataagattcaggacaaggtaagctttggaaccaacgtgacagaggtgcttaaccaggttgccgcatccagtgctgacgcaggtatcgtatatgcaaccgatgcagccagcatggctgaccaggtggaagtggtagccgaggctcctgagggaagccttgccaagaaggtcatctatcctgtggcagtggtgaagaacacggctcacggggaagaggccgggaactttgtggaatttcttaagacagacgaagccatgaaggtatttgaggcatacggattcacaaaaggcgagtaaggaaaaggggaggaaccatccatggactggtcaccaatactgatatcaatgaagacagccggcctgtcgattctcatcacgttttttctgggaatctttgcggcgtgggctgtggtgagcatgaaaaatgagacatggaagctgatatgggacggcgtgcttacgctgccccttgtccttccccccacggtggccggttttttccttctctacatttttggggttaaacggccggtagggcagttttttattgagtatttcagcgttaagatagcattttcatggacagctacggtgattgcggccgtggtcatgtcctttcctttaatgtaccgctctgccaggggagcatttgaacaggtggaccagaacctggtggcggcagccaggaccctgggcatgagtgagtggagcatcttctggaaggtgcttatgaccggaggcctgcccggagtagtcagcggcggcgtgctggcctttgccaggggcctgggagaatttggggccactgccatgatagcgggaaacatagcgggcaggacaaggacccttcccatggcagtctattcagaggtggccgcaggcaatatggatacggcgtaccgttatgtggcggttattgtggtcattgcattcctgtccatcctattgatgaactgggcagcgttaaggcccgtgaaccggaagggatgaaaggggaacagccgtgaactcagaatacaatcttcatttggaagttaatataagaaaaaaattaaaggatttcagtctggacataaactttgaagcgggccggggatgtctgggtatcctgggaccatcgggctgcgggaagagtatgaccctgaaatccattgcaggcatcatccggccggacgggggaaggattgccctgcgatatgcccagggggaggcggcgggaggccgggtcctctatgattccgccctgaaggtcaatgagaggccccaggtaaggcgggtgggctatctgttccagaactacgccctgtttcccggcatgaccgtggaacagaacatcatggtggggttaaagggaggccggggaaacgtggggcttagaaaacgccggcccatgtcccaggaggccagggaacagaaggtggctgagatggtggagcggttcaggctccatgggctggaaaaacgttatcccggccagctgtcaggcggccagcagcaaagagtggccctggccaggagcctggcctatgagccggaggcgctgctgctggacgagcctttttccgccatggatacatatctgagggagggattgcgcctggagctggcggatgcccttaaggattatgacggggtgaccattatggtgacccatgacagggatgaggcataccagctttgcggcaatcttctgcttatggacagaggatgtgtgctggcggcgggcaggacaagggatattttccagaatcccattacatgccaggcagccaggcttacgggatgtaagaacatttccaggattgagcggctgggagaacgcaggatacgggcagtggactggaacggcctggagctggtcacggaccgccctgtggatgacaccataacatcggtgggaatcagggcccatgatttcgaacctctgtcagacagcggtgcacaggcctatatggagagggaggatgcaaatcttataaaagtatatgctccatctatttccgaaatgccgtttgagtggtatattacattacagaacggtctgtggtggaagaaggggaaggatatccacacacacgaaaccgcgggcctggtgccggattggctcagggtggagccgtccgctctcttgcttttgaccggagagctttaaggggcggatatcaggctatcatattacagagaaaggcggaacagacctatgaggacaggggctgttattatcgcagcaggtcacaagagcacaatcagccgtttccagcccatgcttcccattggggacagcacggtcatacggagaattatcattacccttaagcgggcgggcattgagcccgtggtagtggttaccgggcagaaggcggacgaggtggaaaaacacattgcaggactccgggtcatctgtctgcgcaatcaggattatgagcagatccagatgtattacagtatctgtatggggttaaattatatagaggatttatgcgacagggtatttatcctgccggccaaattccctatgttccttccggataccatacagaggatgatggggtcccgggccatggctgcctgtcctgtgtttgacggaaggcggggccatccggtcctggtatccaaggcagccattggcccccttttaaactatgaggggggaaaaggattgagaggcgccctgcgccagccggaaatcgatgcctatctggaggagataccggtggaggacgagggaatcatcatggcagtggaatcggacgaggactgcgcccggggcagtcttggacgggaaaagctggctgtgtatccccaggtgcagctgacactggagcgcaatgaaggattttttggtccccaggcagcccagttcctgagcctgattgaccatacaggctctatgcagacagcctgcaggcagatgcatatgtcctataccaagggatggaagattttaaaggaggcagagcggcagctgggctatcctctcctgattacgcagtcaggaggggcggaaggcggtttttcccagctcacacccaagtccaaggagtttctggaccgttatctgcggatggagaaggaattgcgcatggaaggcgaacggctttataaaaaatatttttctgcggaggaagaggcggggtcatgaaagcattatttacagagttaagacaattattggagcagggggaggaggctgttctggtgactattattgccagttccggttccacccccaggggaaccggttcccggatgctggtgaggaaggacgggtccatagaagggaccgtgggcggcggcgctgtggagtaccaggccatccaggcagccatccaggctatgaaggacaaggcttcctttgccaggggattcaccctcaccagaaaccaggtggctgatatcggcatggtgtgcgggggaaatgtggtggtatatttccagtacatttgtccgggggaccaggcgctgtatggtttctgcggccgggttctggaggccttggcaaaggatgaggacagctggctcattctggatatcaccgacgagacatgctggcagatgggcctgtacagccacagcctgggtctggccggtatgaaagggctggggcagtcttgtctggggccgggagagactggggaaatcagcggcgccggctcatggagcgggctggaaaaagaactctttggcagcaaggcccggcagaaatcagtggacggccggaattattatatagagcctctggtacaggccgggaccgtctatatattcggaggcggccatgtggcccaggagctggttcctgtgctggcccatgtgggattccgctgcgtggtcatggacgacagggaggtatttgccaatccccgggtatttccccaggcagacaggactgtggtgggagacatggaacacatcagcgagtatgtggatatcagttccagggactatgtgtgcgtcatgaccagggggcaccagtttgattattatgtgcagaagcaggccatggccctgcatccttattatatcggcatcatgggcagcaggaacaagatacgggtggtgacggataagctgctggcagacggcttcacattggaggaaatccagaaatgccacatgcccatcggcacggacattggagccgagacaccggcggagattgccatcagcattacgggagaactgatagcgcagagagcagccaggacggatgcccggcagtgatgccgccgggatatacaaaaaattttaggttatctaaaatattttgcattcatgcacaaaaaacagagaggtgttcaccaaaagattagatataatgcggattgctaaacaggtatgcctgacatataatgaatctatcacagtgatggaaaacatattagaaggaaggaatcgataatggcagtcatcggagttatactagtgtttggtatcctgagttttgatttgtatggtgtaatcaggaataatatccagaaatagggacgcaacaggataagatagtcagctgagacaaaacactgaaatagaacagcagccggaagcagaggggattccccttgtttccggctgtttttaactgcccttaaagggcagaaaattatctttccctatcttctgttttatgatagaatagtcagagtatcacagtaaagtgctgcattaatctatgtcaactataaaatggagattatgccatgaaggtctatttttacgagtgcggcatatggaccggaaccaacagcctgtggcacggcctggggcttgagggacggatgaagcaggcacggtcagagaaaggaccgggcccttttgtggtgtctcttgcaggcgcgggtggcaagacatccgccatacgcagactggcctgggaggccctggaccgggggcttaaagttttggtggcaaccaccacccatatggcttgtccggatgcattcggatgccttgagggcaatgtggaagaaatcagggctggtctggaacagcgcggcctggcagtggccggaaggccggcggagaatgggaagattgcatttacaggccgggagttgtatgaggaagcctgttccctggcggatttggtgctggtggaggctgacggttccagacgcctgcctttgaaggtgccaagggccggggagccggtgattccggagaatacagatatgattctgtgcctcaatggcctgacatcccttgggaaacaggccggggaatgctgcctgagactggaggaagccctggacctgatgagccgccacggccggaaattgtatgggcatgagtgtgttttttccggcaaagaaccggatggaccggaccggaatagggaatataagagcgactgggtcatacaaaaggaagacatgatgacgctgatgaagcatggatacctggtccccctgcgggaagcccatccgtatatggaggtgctgcctgtattcaaccaggccgacactgcgcagaaagcagcgctggccaaggaaatgctggacggaatgggtgagacagcagggattgcaagcggacagctggaccaggatgggtccgcccggttattttaaaggatggttatgagggatgaagatatcatttatctatatggcttccggatttggaagccgttttggctctaataagctgctggtgccctttaagggaaaggagctttaccgccatgggcttgactgcatctgccgggcggcaggggagctggagaaagatgggcaccagacagagattctggtggtcagccagtatgaggagattttagagcaggccgtaagccaggggcttgcggcagtccacaacggattcagcggggagggaatcactgcgtccctcaggctgggaactgcttcggctgctcctgggacagaggctcttttgttctcagtggcagaccagccctatatgagtcccttcaccctgaagaggtttattgaggggtactggctgtccaaaaaggggatgggctgtgtgtgccatcagggaaagcgggggaatcccgccatattcagccgcacctacaggcaggagcttatggggcttcgcggggacagggggggaagcgtaatcatgaaggcccaccctgaggatgtgtggaccatggaggtgccggaggaggagcttagggatatagacagggcagaggatttgtaaggaaaagtggtggaaacatgaaacagtcggatactcagttggctaaacagccggatactcaattggataatcagaagaaaaacgatttttccaaaggcagcgtggtgggcaatatcatgaagctggcggtccccatgaccctggcacagctcatcaatgtgctgtataatattgtggaccgcatttacataggaatgataccggagaatgccaccctgtcccttacggggctggggctttgcctgcccatcatatccattgtcattgcctttgccaacctcttcggcatgggtggcgctcccctgtgttccattgaacggggcagggggaatgagaaggaggcagaggccatcatgggcaattcctttgtgatgatggtggcggtgggaatcctgctgacggtcctgggcctgatttttaagcggcccatgctgtaccttttcggcgccagcgacgccaccatttcctacgcagacgcctatgtgaccatctatctcctgggcaatatttttgtgatgacaggcctgggcatgaacagcttcatcaactcccagggctttgggaccgtgggcatgatgaccgtgctgctgggggcggttgccaatattgtcctggaccccattttcatctttgtattccacatgggggtacggggcgcggccctggccaccattctttcgcagatgctgtcagccatatggattctggccttcctgaccggcaggcggaccatcctgaagctgcggcccgcggccatgaggccggacggcggcaggctgctccgcattgtgggcctgggcatgtccgggtttaccatgtccatcaccaacagtcttgtacaaatcatgtataattccatgctccagaaattcggcggcgacctgtatgtgggaatcatgaccgtcatcaactcagtcagggaggtcatttccatgcctgtaaacggtctgaccaacagtgcccagcctgtactgggatttaactacggggccagggagtataaacgggtacagaaggccattgtattcatgtcagtggtctgtatcctgtatacagtggtggcctggggattcgtggactggtttccggagttcttcatccgtattttcaaccgggagggggacatggtggaggcgggaattccggctatacgcatgtatttcttcgggtttttcatgatgtccctccagttcgcgggccagtccgtgttcgtaggcctgggaaaatccaggaatgcggtatttttttccattttcaggaaggttatcatcgttataccgcttattatcatactgcccactgtatttggattggggacccagggcatactgatggcggagcccatatccaatttcatcggaggagccgcctgtttcgggaccatgctgctgacagtatggcctgagctaaagcggggcggggaaaagaaccagcgctaaaggagaaaaaccaatgaaaagaccttatataaaggccgcaatgatactgggggcggcagcgttcctgttcacaaccgggtttgccagggcagaggaacatgctgcgggaacagcaggctgccttaaatcagccacctactattccgatgactgggtcatcaatttctggaacagtgagagccgccatatggaccaggagctggcccgcattgcggaggatggatttaacaatattatcctggtggttccgtggagggaattccagcccggtatgtcgccctgtacatacagccaatatgcctgggacaagctggaccgcgtcatggatgccgctggggcccaaggactgagcgtgatgctgcgtgtgggatatacctgggattactgcggggcaggcaatgtgatggaccggtaccaggggctgatgcagaaggggacggaacggtctgcctggatggaatatgtgggccgcctctataaggcggcatcctcccatgaaaacttctgcggaggattcctgacctgggaggatttctggaacttcacggattccagtgcgtccctgggaaacggggtaaagggacgcagtatggccaaggcctgcggatatgtggattatgccagggagaattatgagctggaagagctggaggaaatgtatggtcacaagctgtccgggtatgatgatttgtattttcctgcaaaggattcacaggccagaagcgtgttttacggattttacgaccattttttaaatgaactcctggccgacagccagaccgtgtttccgggcctgtccatggaagtgcgcctggatgtggacccggtggagcaccaggacggaagccaggagggctttatgcattcctccaccttccccagcggaagcgctgcctataccagcgcaatgtacggcattcccatgggctttatgaatgaacatgaacgcgtaacagcccaggaggcgctggaaaaggtgcctgtgttcctgaaccgtcttcacgtgtacagcggaggcaagccggtgtacctggaccagttcctgtttacggacaatacggttggatacgagcataacgcccagctgcgggacgatgaaaaggcgctgtatctggaaggcgttgcgcccatccttaaaaattccaccatgggatatggtatttggacctaccgggattacggggacaataagctgttcaatgcccagtttgccctgggcatggacggatggcgtttttcaggaggaagctatattgcggaggatgcaaccggaaaatcagccatgcttccctccggcggaactatttaccagaacctgggcaaccggatgacaggcaatacaggaaaggatacctatgtaaagctgcgcaccggggcagaggaagcatgcaggctgaccatacgcatgggttcccagacaaggaccgtggacgtgaaggaggaacggaaggtggagcttaaattcagcaactgccagccgtcggatttcaccatcagcgtaagcggcggcaaaggcgcttttgtggacgacatccaggtatatacctttgtgacccagggcgagctttacaatatggacggcagcgaaggaaaatgcattgaagccctgcgcctcatgaatcaaaaattataatccgtacatactatccttgtcattggtaagaatggtaccgcacataagaaaccgggcttcggcttcttatgtgctcataacaaggaggtagggatgatgaccaagctggaatgtagtgtaaagaactgtgtgcacaacgctgacaactgctgctgtaaggctgctattgcagtggatgggaacaaggccgggactgcggagcagacctgctgcgcaagctttgacgagaacaagggcggtaagttcaccaacctgttcaagacccctgagacaaggctggagattgcctgcgacgcggtaaaatgcgtctacaatgaagaacaccgctgctccgcggaacgtattgacataagcggtgacggagcctgtgaatgtacggagacaaggtgcagtacctttaaggccagataaattcagaatcaggacaggatgggtgcagggacgtcttccgggaaccgggaggcgttcctgctgtatttggatgaatcatatcgaggaaacgtatccggaagaaaagtttgaaattatggttgacaaatacgttcaaatgtagtagattaatataagttgtgagaacgactgacaggaaagcaggtatccgcctcaccctggcacaagtaagtgacccgggttcatagatgaaacaatgtgctgtagtatctccttggatttccggtgagacagggcagcagatggttttatgtgaggaagtggatagccaggctgtccgctttattttttgccctacagggaaagaacggggcatgctgattccagaacaacatgacttatttggaggtgtacgactattagcgaattaatgattaacgagcaaatcagagacaaggaagtacggctgattggcgaggacggggagcagttaggcatcgtgccggggaaagaggcactgagaatggctcaggaagcagagcttgacctggtgaagattgcacctacggcaaagccgccggtatgtaagattatcgactatggcaagtaccgttatgaactggcacgcaaggaaaaagaagccaagaagaaacagaaggtaatcgagataaaggaagttcgtttgtcacccaacattgacaccaacgacctgaacaccaaggtgggagcagccagaaaatttttggagaagggcgataaggtgaaggtgacacttcgtttccgcggtcgcgagatggcccatatgttcaagtccaaatacatcctggatgatttcgctgagagtttaaaggatatcgcagttatcgataagccctccaaggttgaaggaagaagcatggttatgtttttaactgcaaaacgttaaaatagaaagttttaaggaggaaatttacaatgccaaagttaaaaaccagcagagcagcagcaaagcgctttaaaaagacaggaaccggtaagttagttcgcaataaagcttacaagtctcacatcttaactaagaagtccactaagaggaagagaaatcttagaaaagatattgttaccgatgcaactaacgcacaggtaatgaagaagattttaccatatctgtaagtttgaattgtagaaggaggaattaccgatggcaagaataaaaggcggtttaaatgctaagaagaagcacaatagagtattaaagatggctaagggctacagaggcgcccgttccaagcagtacaggattgcaaagcagtccgtaatgcgcgccctgacaagctcctatgcaggcagaaaagagagaaagagacagttcagacagctgtggattgcacgtatcaacgctgcagcacgtatcaacggcctgtcctacagcaagttcatgtacggcttaaagttagctgaggttgacttaaaccgtaaggttctgtccgaaatggctatcaatgacgcagagggattcgcaaaattagctgaactggctaagtccaaaattgcttaattgagaattgatataagattaccagagggtattgcaggacaagctgcagtgccctctttttgagacagccggtaaaggcctgaggaagagagggggcggatgaattgaaaaaagcgcttatatacgggattctagcatcctttttctttgcatttacctttatcctgaacaggagcatgaatctggccggaggatactggatgtggtcggccagcctcaggtacctgttcacatttcctgtattgtggcttatgctggcacgaagccgttcggcaggtaaggtgtggaaggctgtaaaggaagcgcctgttccctggctggtatggagcacggtgggattcgggctgttttacgcgcctctcaccttcggctccgtattgggtgaatcatggctggccgcagcaacctggcagctgaccatagcggcgggcgtgcttctgacgcctctgtttggaaaacagataccaatcagaaacctgggatggtctattctcatactggcaggcatattcatgatgcaggtgcctcatctggaacggatggaagtgaggaccgtggtcctgacgctggtgcctatattggcggcggcattttcctatcccctggggaaccgtaagatgatggccctttgtgcggagaccatgaccacccttgaacgggtatacggcatgacactgtgcagcatgccgttctggattgttatgtcggtatgggcctgggtaaagtccggaccggcgcaaggcggacagatattccagtctctgtgcgtggcgctgttttcaggcgttattgccacggtcctgttttttaaggccacagacatggtaaaggacaatccgcgccatctggccgtcatagaggccacccagtgcggcgaggtgctgtttaccctgctgggaggcatcctgctgctgaaggacaggattccggagccggtgggactggccggtatcgctgtgattgtggccggtatggtgggaaacagcctgtcggcaggagagtagcccggagtccccggggctggtccgccggattgcaggaaggaaataagggaaaaagcagcctccaaacgttataataaccaaaggaggttgtgggcaatgattaaggatgcatatgtacaataccagtcgccaaaagcggcaaaggacctgtttgatgcaatggaactgctgccggggcgggtgaagatggagcaggatgtccactatattgacgatgagacggctgccatgaatctgcatctggctctgatgatggcggccctggaggacgggctgtggcagtaaggctgtttaggtgacggtatatgaggcaggttaccggaatgaaaggaagaatgagagggaccatgaataaggcggacaacagggataagaaccggaatgaaaatcttttatggaaagtactggatgaaaccactgtcatcaaggatgcatggattgatatgcgcgccagcacctgcaggctgccgggcggcatggtcattgcccccttttatgtcaatcatctgccggattttgcggtggtggtggctgtaacgccggaacacaaggtgattttggtgcgccagtaccgccacggtgtggagaaggtgcttctggagctgcccgcaggatgtatcgagccgggggaggacccggaggcaggggctgccagggagcttttggaggaaacgggatacaaggcggggagtatggaatttctctttaaaattgcccccaatgccagcaactgcaccagctacgcccagtgctacctggccagggatgtattttcggctgcggcccagcagctggatgatacagaggcactggaagtggtggagatggagggggaggaagtaaaacggttcctgagagagggaaggtttgaacaggccgtgcatgtggcggccctgtacagggccgcggagttaggggcactgggataaatggatgactgtaaatgtgatgtgtgatgcccttcctgggtgagcgtcccatcaattgtttgcggtcattttttgtttgtacgccattacagggacaatcagtgaaaaatctctacggtttcaattatcaccggttttgtaatcatcccttgcccagttgggcgcattgacgggaccggctttggcgttgccgtttttggcggctccctggatttcgggaacctgggcctgctcatttttgggatggttcattttatggtgattttcagttccatgattatctgcgccgtaagggctgggtcttctcattcctgcttttgccattatcatacctcctttccatagtagtttttgaaccattggctgaaaatattcggaaaagtagaaggaaaatatcaactgaacctataggtatttttggtaatcactggacattgatagtttcatattgatagttagtattttttcgtgtatcctatttttagtaaatcggtatctgtaaaggagtgtttaatattggattataagaaaaaagcaattgattgtgttaaggacacggttttacccattcaacgtgcccaatttgaagaatgtggatgcagcttagatgagcagtataaaaaatacggcaacacagaaatgcttatagcgagaataattgacccggggcatatctatgaaataggctatcctaaatgcgtttgtgatgaggtgctgtctggcaaagtaacagaagtgtcccattgcgaatgctcaaggaacagcattttatatattttacaagatttattaccggacaaggatatacaagttgaaataatacatacggtattaggtggagctaatgattgccgatttaaggtaactatttgctgaaacagattatattagtaatggtcaatttggagccgctaaccatcgaaatgttggcagccaaaaacaagtctccccttaaggctgaaatacctaaaggggagaatgacaatgagctatgatggatgataaggaactccattcgccgcataaggtgtgccctgccaattaaatgcgataattgcttgccaggtagggggaacagcggcgagcgctgcggtgagagccgcatcaccggcagtcttataaaaatcttcctgggtacggctatttccatcagcataacttcatgctatattctacctatatatattactctatcagacatggtaaagtcacaaacatgcaaaaaaacaacgtaaaaacgtactttttgaccccgcaatattaaggaatcgttaataattattattttgcattcccacccaatatatggtacactgagtcctgtatcatagattgttttacaggagtggttgcaggaatgctggaaatatcaggaatttataaatcctttcacagacagagtattttagcgggagtggacctgacggtggctccgggagaatgtgtgggtatagtggggtataacggctgcggcaagaccactcttttatcgattctggcaggcgcccagaaagcggacaagggcagtatcctctacaacggcaggcaggcgtcaggccatccccgggtatttgcggaggaggcagcttatgtgccccaggagaatccgcttatggaggaactgaccgtaagggataacctgcttttgtggtacaggggaagcaggaagcagatggaatcggatttaaagggcggagcagcttccatgctgggcgtggaccaaatgcttgaacgcacagtgggaaagatttccgggggtatgaagaagcggctcagcatagcctgtgccctgtccaaccacgcaccggtccttatcatggatgagcctggggcggcactggatttggagtgtaaggaaatcatccggcactacctcagggaatatatggcttcaggcggggctgtcatactgacatcccatgaactggcagagctggcgctgtgtacgaagatgtgcatattaaaaggcggagttttaagtgaaatcgattgtggtctgtcagcgaatgagctgattggccagtttcgatagatacataataaagggcagccggtgcggtatgatgcagggcagcggaaaggtccttttacaagggaggagagagaaatatgaaatgcaccaagtgtggagcagagcaggaagcagatgtaaaattctgtacccagtgcggagctccgatggaacatgacaatcaggcgccggaagacggcggctctgagccgttaaaagaagaggcggcagctgagtccgggtctgcaaaagaagaggcgccggcagctgtctgtgcgccggaagagcctcagccgaataagaagttcgtcaaggtactggctgctgtggtggccattgcggctgtcattgccatcgcggccctggcttatatgaagatgaacacaaaggaccccaagcaggtggttattgatgcctttgaaaatgtgtttccggaaggccaggtatatccttctgaggagctgttcgggctgaaggattttgctgagacagtgaagacagccgacagccagggcgggctgaccctcaagatggacagctgttcggatgagacagtcaatacctatgcgggaagcggccttcgctttgagacaaaggatgacaagaccaatggaaaaagcttctttaacatgggcgtaatctataacggcatggaccttgccaatctgaatgcatattatggggacgataccctgatgcttgcggttccggagctttccggcaaggtgtttaccgtggacctgggagaaggactggcggaccgcattaagaattcgcctaccgtaggtccgctgctggagcagaacggcgtggatgtagaaggcatggcggcttatttcacggagctggtagatgaggctgaaaaagcccagtcagaaggcaagcagccctttgatgtggaagcgctgattacccgttacaaagagggatgtaaggcccaggagaatttcaaggcagccctgaccgttgaaaaagccggtaagggaacctataccatggacggcgcacaggtgagctgtcagggatacaatgtaactgtcagcaaggattccatgattgaattccttcgcctttccactgatttcttcctgcaggatgagactctgaaagcagatttcatgcgccagctggagactactgtgaagatgagtgagcttatgggcggaaccatgtcaggcacaggaaacctgtccgcggaggagatgcagcagcagtcctacgaggaggccaaggaaatggcggaccagatgatagaatatctggataaggcgctgaccgatgtgaatatgacggtttatgtggataaaaagggacgtctggcagcagtggagggctctaccaatctccatgtggatgattcggatgtttccgaagagggctttgtggcagtgacctttagctgccagcttcagggcggttcttacctgacacagaatgcactggccaacattaccctggaagatgccacggatacagtgagcattgatatggtaaagcagggaacctatgacggaagcgtactgaccagtgacctttcactggacctggctgtgccggatgatgaggcttataattttacatatacaagcacctatgattccaaggacggaagctaccacctgtccggcgaggtaggcggaaacggttcgcagcttgtgaagatatccgcaaccggcgcagtggaccagctggaaaagggcaaatctgtgcatgtgaacattgattccctggagacatcggttctggatgattccgtgaatgtggttctcagcggcgaatactattaccagcctctgtcaggagaaatcactcctttagagggcgaggccatggatatgctgtctgccacggaagaggattggaccaatgtgggaatggaaatgctgtttggcgtcatgggattaggcagccagctgggagtatccatgtattaataagataaaaaggaatgggaagatatgtctgcacgtctggtttatctcaggcttgagttaaaacgagcatgtaaaaagcttccccacatctttgcaggggcaatcgtgctgttacttttagcgggtacgattgcccttttgtcagccaggatgctgtatggggaaaagtcagcaggaaggattgccgtaggggtagtgcttccggaaggcgatgccgttgcgaagaaggcactggccatggtcagttcgctggaaagcgtcaagagcatctgcgattttgaatatatgaataaagaggaatgcctggataagctgaaagcagggaaattgtatgcggtgatggaagtgccggagggatttgtgcaggacatcatgaacggaaccaatacgccggtgaaaattctgctgcccaggggggcgggcctggaaagccgcatcttcaaggaattgacagatgcaggcgcctcgaccctgggagcaagccaggcgggtatctatgcaggggatgaactgctgtacctttatggcatggcggattccgtaagcagcctggaggcggacctgaaccggatatacatgggctacagcctgccccgaatggattattttaagaatgtcaaggtcagtgcaacaggagatgtggatacgattcatttttacggtatcagcacagcggtgctgtttctgctgctctgcgccattccggtgtccgcctatctggcttcaggctctgtgtccatgaagcggaagctggcgcttatgggagtgggaaaggggaccctgatggcagccaggatattgggagtgggaatgctgtttctggcagtggctctgtgtacggccctgggagcctccttcatgggactcataaagctaagcctgcccggactggcagcccttgtgatggtctgcctgggggcggcgtccatggtggtattcctttatcaggcagccggaagccttatgggcggcgttatgctgctgtttctggcagtgactgccatgcactttttggcaggcggattccttcctctggtattcctccccaccacgttccgggctgcggccccgtttcttccctcctacgtgctgatggaggggatgaagcttgtggtcacatcgtcctttagtctggcggtattcataaagctggcagtactggccctggccggtttcctgttcagcgtgggagtggaggtggtcagggaatgaaacgggttgctatgtggtttttgctgtcgtgcaaacgatatatgagaaaatggtcctttctgttcatcctgctgctccttcctgccggggttctggcagcgggccaggcccagaaacagggcagccaggaagtgaacatcgccatcagtgtggaggagagcggtgagaatgcgctgggagacgccctggcggacagtcttctgaaccggccgaggggagaggaggcaggcatgttccgcttctatctgtgcagtgacgaggaggaggtcagggcggaggtggcatccaggcgggctgaatgcggttacgtggtctacggcggactgagagagaagctggattccaaatcctataagcgctccattggcgtttattcggcgccgtccacagtggcagccgccctttccacggaaactgtgtttgcagccctcatgaaaatatatgacggggaactgctggcggattacgtggctgaaaatgagctgttcggcccggtgggagccgcaggcagcgaagccagggaagccgctgccgcacaggccggagagctatacacaaaatggctggacaatggctccacattccggtttcagtaccagttccaggggcaggaaggggaggcggcggcctttggggacagccggacagatgtatttcctgtcaggggtctggtggctgtgtacgtgttcatcacaggtctgtacggggctgtggttatgtgcagcgatgaggaacgcggcttgtttctgcccctttcatacggatacaggattccctgccgtctggcctccatggcggcgcctgccgtgatggtctctgtatcgggtctgctggccctgaaggcaggaggcgtgatgacatccctgccaggggaaacactggccatggcaggttactgctgcgctgtcatagcgtcagcctgggtcctgcgcctggtatgccgcaggccccaggtcctctgctgcatcattccattcctggttattgggagtcttgtgttctgcccggtttttgtggatgcaggaagatttttccccgggctggaccaggtggggaggctgtttccgccgtggtattatttgcaggtgttcaggtaaaagaatgggataagaagagggatgagaaagctgatattgttttctcgtccttttttcatgacccattttatattttacctatatataaagtgcggagaatggtgttatgcttttaataaactaaaatgattttgtgataattgcacaaatagcagatggaaatgtgtttataattgacaaaaagaagaaaagctgcaatatctgattgcttttttgtttaaaagcggctatactcttcaataagaggtaggaccagttttaaagactaataaaataaatcttttttttagataaagtggtcctaccaatcagagaggagggaggaaaaattgaagttttcaaagtttattgagaccattgatacccatacatttggcgagcccaccagaagcatcattgcaggtgtaccaaggttaaagggtgatacaatgacacgtaaacaggagtactttaaagaacactgcgattggatacgcaccatgactatgctggaaccccggggcgggaatgtaatgtcaggcgcggtaatcacggagccctgtatggaagaagcggatgtgggcgttattttcattgattccggcggatattttcccatgtgcggtcacagtaccatcggtgtgacaaccatgctggtggaaacaggaatggttccggtaatagaaccatgtacgactgtaaaactggaaacaccggcaggtttagttacggctgtggcccaggtggaaggaggacgcgtcaaaagtgtaacatttgaaaacattccttgtttcctttatgaaagtaaaacacttttctttgagggagccggagctgtttccgttgatgtggcctatggaggcggaagttttgccctggtaccggcgcaggcatttgggataaagctggtggctgggaatcttccggagattctgcgctggtcaaaaatcatacaggacagagtcaatgaggatatagggttccgacaccctgaaaagccggagatttgcggtgtttcccaggttcattggtattctccgcctgtggagcgggaggatgtggatgcccgcagcgtgaatgtttttcttccgggggtagaccgttctccctgtggtacagggacatctgcccgggcagtgacattatttgtccagggaaaactgggactgggcgaagaattttcccaggagagtctgaccggaggaaaatttaccgcaaaaatcaagcagtcagtaagtgtaggcggatatcccggagctgtgcccacattaaccggtgcggcgcatattaccggattccataaattcgtagttgattcagaggattctcttgcatttggatttcctttctgaatccattaacgccatcataacaaaatataggaagggaggtgaaacatatgatagagagatacggaggaaacggaagataccataatgcagtcatttgtaatggcgttctctatttgtcaggtcagacagccacggaagccggtgatgacattgcattgcaatcggaagggaccttaaaaaaaatcagcagaattctggaagagtatggttcagataaagaccatattcttcatgcagatgtctatgtccgcaatcagacagatgtgcaggcattcaatgctgcctgggatgcctggattaatccggatactgcaccgtcgcgggcttgcatggtgacggccctgggacgtccgccgattctggtagaggtggtagttaccgcatccgttaagtaaaacacggggtaacaaattctggttgcatttttctcatgaatcattataatcaagagatagaagtaagttgattaggagagaacgatgcagagtcagaacagtgtgatattcaaagaaaataagaatgttcagaaattgatggcctttatcacggacaagggattctgcctggatgaacggctgccgtcagaaagggagatggtttcgctcctgggaatcgggcgcaattcattgcgggaggcactgaaggttttggaagcaatgggggtcgtggagattaagcatggaagcggtatttttctgcgcaagacggatgtgtcccccaatggagactcggctgtgtggcttctgatacataaaaatgagatattcaatatgattacggtccgtgaggctctggatttaaaggctattgatttgattcccgaggacaattattcagggatacgcgaccagctgaaggcctgtatcactgctgtgagaaagacaggtctgagcaatggagagcttctgcagcacgatttagagtttcacaatatcatccgcagggcatccggcaatgacattctgctaaatatctgcgtagcgctgacgggcaatatttatgacgagcgcaaggtactgttcagccaaaaccagcgtatagaacagtcgctgtgggagcacaaccagattgccaatgcttttggctccaatgatatcaatcagattaaacaggcatatgtagcccatatggccagtacaagggccagtatcgaaaacgcacagcctaccaatatataggcacggctgtttagaaggcggagaacttggtattgtgcctaaagtcatcctaccaatttttgaaaaaactaaaaaagaaactatgtcatcctgccaattttgccggaaatagtgtgccggctaaattcagcacaaccaaaacaaagtcgtaaaggagaacgtatatgcaggaaataaccaatttacaacgcgaaatgttaaaaaagtatgaactggatgcaatggtcaccatgacgccggagaatatcacctatgttaccggagcttatatcccgacgcaggtaacggtcagaagccgtaaggtcatccacattatcacggcccagcataatccggttgtcattgtggtgaatattgaggaacccattatgcgcatgcagagctggatgcctggagataaaatcatcagctataatgaatttactgaaaatcccgtactcatagccattgagaagctgaaggaatttggtatggagaataaaaggattggcatggaattgtcctatctgtccgccatagacagcgatttggttcgccgggagctgcctcatgcgatgattgtgaatgccgaccctgcctttgaggagatgcgattccttaagcttcagtttgagattgaccgtattgtggagttcggttcccacattgaggatgtgatttacaatgcatttgccaatgtgtctgccggcatgacggaaaaagacatctatcgttttattgccaatgggtttaacgatatcgccaagggcgacaagatgtccatgcccatggttggctccggtgtcagaagctgcctcttaaacggtgagcctacggataaggtattggaaaagggcgatatagtgcgggtggacgtgatgggaaccaagcagaattattactgcgactgctgccgtacagcggtggttgggcagccggaggcacgtcatgtaaatatctgggaaaagatggtcaaggcccatgatgatgccattgcccagattaagcctggcgtgagcactaagacaatatatgacaattttgcaaagcagtttagcggatggggatttgagcctgttgcattcattggccatggactggggctgaccctgcatgaggagccttatatcaatacatataaggatactatactgcagaagaatatggtgctttgtgtagagcctatccatgtaattgacggccagtgcgggtaccagctggagaacgaggtgctggtgacagcagatggacaccagatgattaccggcaccagacatccatatcagcagctccctgtcatcaaggcggattaaggaggaaggtatgaaagtagcggtactgggcggtggacacggaggatatgcagcagcagcagatttaaccataagggggtttgatgtgagcctgtttactttttcagcggacagagccgcagcattccgcaagcaggacaaccagcttatgtatgagggcgtctggggaaatggacaatgccgtatcggatgtgtcaccaaccacataggggaggcggtagacggagcagacctggtggtcatgaatgttccgggaaccggtcacgaaacatatcttgaggcgttgcagccgtatctgaatgaggatacggtcctgtacatgaatccgggccacagcggaggcgcacttcgggcagccggaatattgaggagaggaaggattgcagaatccaacacccttagctatattgcaagaaaaaccagcgaaacaagcgttcgtgtcagcagcagcgataaaccggttacggtaggtgtctttccggcagaccagacagaggatgtgctgtcggtaatccgcagggcgtatcctcatgttgtggctgccagaaatgtgctggagtcatctctctgtaatgtcaatgccatgttccatcccccgggaatgctgctgaatgccggctggattgagcacaccaaggggaatttccggttctactacgatggcattacgcctgctgtgggaaacgtcatacggaagctggatgaggaacggctgtcagtttccaatgcctttggcctgggtctggatgatttctgcacggttttataccatgccggttccacgaccagggaagcagcagagagcggggacccctaccgggcatgccaggagagcagagcgaaccagttcatattggctcctccgggtctggaccatcgctatatgcatgaggatattggctccggtctggttcctatttcagaactgggacggctggcagaggttgggacgcctctgaccgatgcgctgatatctgcggcagaagcgctgatgggtaggaattatcgcagggaaggtgttaatctggagaagatgggaatagaaggaatgtctgtacaggaagctattaactatgtaaaaaggggaatggagttctaactatggaagaaaaaaagattaccgcacaggaggaaaacgtcctggcagctagtgaatatgcatatgaagcaattcccgacggggcgaagaagagcgcatggagtatggttattgttctggcaggttatctgattgcaatgtcaaattttgttaccggcgcagccgtcggatacaaaatgacctttggagacgctgtgaaggcgctctgtgtatctgatatttatctggtattcatctgtatcgccatggggctgattgcttttaagttcggcatcaccaccactgtaatgtccagaaaggtcctggggaagaagggctctctggtgttgtctgtaattttgtcgctgtctgttgtctgctggctgggaaccaatggggatacgtttgctaaaatgattgttgcagcctttcccatatggcccatacccgttggcattactgccgtgattctgatgtttgtatggctgcagtctgcctcccggggatacaaaggactggaggtggtaagtatgctgggggtacctgctgcaatcctgctctgtatctgggttgtcatggcggcatataaggcaaccaataattttgaatccgtcctcgcctatgtgccggagggaaattattcctttacgcaggccaccacagccggtgtggggtcatggattttcggcgctatctcatccatggatgtaatccggtttgccaagaaaaagtctcattttgtggttggaggcattgtttctttctttatttgcctgctggccctgcagctgaccggggttatctgcgcccaggctacgggtaagagcgattttgtcagttcggcagccggtcttggcatagcgcttcctactctcatttgttctttttttgccctgtggacgactcaggacaataatatttacagtgctaccttaagtatacagaatatccttggccagacttccctcaaaggcaggttcaaacacaaaagcattgcgtatgccctggcaatcctggccgcagcctttagtctgactggagccctgaaccacgtgctgacctttgtgtccacgctgtctgttttattggcacccatacccggtctgtatctgtcggaggtatatattattaagaattcttcagaggcaaggtccttcagttcctggggattcatctcctggattgcagccggggcagccggatattactgcaatgcaaataatgtcctggtgccgcctgtaattagtttcctggtagcattcacgctctataccgtgctgggcaagctgttgggaaaggagtcatctcaatgacacatattcttattattaacggaagttccaggaaagaaggcaattgtcagattctggccggccaggcatctgctggggcagccctggttaaggatacggaaatacgtcagtttacattcgccggaaaggcttttgcaggatgcagggcagaatgttcagcctattgtatgaaaaacggcgactgctccattaaagacggactgcaggaactgtgggaagattttatatgggcagatggaattgtctgggtggttcctgtttaccatgtaggggttccggggcaggttaaatgtgcaatggaccgtctgtgcaatatgcagtacagctacttccagggaaaatacccgcgctggaataaggcgtggggctccattgtacaggggtcaagcaggtggggcggtcaggaatataccattcagtggctgattgaatccgcattgctgatgaagtgtattcctcttgcagcggatgcccccggaagttattttggggtggcaggctacgcgcccacctgggaaaaggacagtatacgcggggataccgcggctatggagctctcggtcaacatgggcagaaggacagcggaactggcccgtatcatccaggccggtctgggatgcctgggggatgagctggaacaacggtattttccggctaagtgtatggaagccagaagtaagacagaactggaaatctctgattcatggcagaccaatcatcagaaaggagtatcagaatgaagattacgggatataaaatatttgaagtgagcataccaaccagacgcaagcacacatgggcaagcagcacggcagacgtggggcagggctgggttattcttcagcttacagcggacaatggtattattggctatggcgaggccactgccatgccggagtgggggggagactttggccgctatttcggtgagtcggcaggaacaacccgcgtggtaatggaagaaaatctgttcccggccattgaaggcatggacccgtttgacattgacttaattcaccataaaatggatttagcaatccgcggctataactatgcaaaggctgctattgatattgcattgtatgatatgatgggaaaggcggtggaaaaacctgtctaccagctattgggcggacagcacagaaaagcgattcccattgcccacagcctgggggtcgtgatggatattgacgcggcagtggaggaagctgtggcagcctgtaaggaagggataaagaacattaagatgaagggtggactgaatcttgtccgcgatgtggaactgatgcaaaaactccgggaagctctcggccctgacatcaatatcctggtggatgccaaccagggatatccttctgccaaggaggctgtaaagtggggtaaacggatggaccagtataatctgcaatatctggaacagcctgtggaaggcctgtatcagctgcaggaggtcacgcgcatgctggaggtgcctgtatgcgctgatgagagctgctggacggttcctgatgcgctggacattgtggctaaccgagcagcggattacatttccatctatacgacaaaagcaggcggtttgtatcctgcccgcaccattgcaaagatttccgaatgtgcaggcatacgctgtaatgtgaatgggtcaggagagtttggggtcggcaatgcggctaatttacatatggcctgctgcggaaaaaatatcaatcttgcgtccgtgttccctataacccatgtggaaggctgcccggaacagacaaaggtggctgcgcgctggtacatggatgatatcattacaaagcctttcctgtatgaggacggctgcctgattgttccggacggtccgggtctgggaattgaaatcgacatggaaaaactaatgaaatatactgtgaagtagtccttagatatgacagaacagcgatagcgtaccggtccggccgatacgctatcattgtcaattataaaaacaaaaaaaccgcagagccttttcaatcaaggtcccacggacttctaaatgaatgcgggagatgggacttgaacccacacgagcatacacccacaagatccttagtcttgcctgtctgccaattccagcactcccgcaacacgaatggtagtatatcatagattttccaacttggcaactatttttgacaattttttttaattttttctaattatcaaatttggtaaaaaatttgaaaaataatgttgacaaattggcattcctcatttataataaccttcgttgcttgagacaagcagcaacacaaaataaaatgcagaagtggcggaattggcagacgcgcacggttcaggtccgtgtggtagtaataccttgtgggttcgactcccatcttctgcagctggaacaggaatctcttaagtgggactcctgtttttttgttccggtttgtaatactcatttcctcatatcgttgcacaattccccccaacctgctataatttaaacaatatgttatacttttttcgcaaatttcatctgacagcggtttctgtgaccagaaccggaatgaggaggacttccatggatttaaatacgatacttgaactgcagagggcgggagtggatacagagggcgctttaaggcgcttcagcgggaactccgcactgtacgaacggttccttaagaagtttctggaggacggtacattttcaaagattacaaaggcgtttgaggaagagagcagggaggatgccctgatggcaacccacaccctgaagggagtgacagctaatctgggcatggataagctctttaatatatcatcttccatggtggactgcatcagggcggaccgctttgaggatgctgccggcgcatatccgcagttgaaagaggcttatgaggagatatgcggaattcttgcaaatgactagcggcagcacgggtctgaaggctgcggagaggaagtgacgatatgcgtcagcgggataccatactgattgtggatgatatggagataaaccgcgtgattctggacggattgtttcaggaggaataccatctgctggaggctgagaacggggagcaggcgctgcttctgctgcggcagtatcatgagaatattgcaatcatgctgctggatgtggtgatgcctgtgatggacggatacagggtgctgcaggagatgggggccaatgggcttctggacgaggtgcctgtggtggtaatcacggcggataattccctggaaggagagctgagggcctttgatttgggggcttccgacatcattgtcaagccctttgagccccatgtggtcaaacggcgggtacataatattattgaactctatcttcacaaacataatctggaagacatggtgggccagcaggcccgaaaactgagggaatccaatgatgtgctggtggatgccctgtcgtctgtcattgagtacagaagcctggaatcgggacagcacatcaagcgtatccgcctgcttacgcgggtgcttttggaggaggtgtgcaggaactgtcctgagtacgggctggataagaaaaagatagaggtcattgcttctgcctcggcccttcacgatatcggcaagattgccattgaggataagattcttaacaagccgggacgtcttacaaaggaagagtttgaaatcatgaagacccatacggtcaagggatgccagattctggagggcctgggacgtatgagcgataaggaatacctggagtatgcctataacatctgccgctaccatcatgagcgctgggacggcagggggtatccggacgggctgtgcggggatgccattcccatctgcgcccaggccgtatcgattgtggatgcgtacgacgcccttacatcggaccgggtgtataagaaagccattccccatgaacaggccttcaacatgattctgaacggcgagtgcggatgcttttcctccagactgctggactgctttaagaatgtggagccggagctggctgaactgtgtaagcggtaccgggacggcaatgtccctgcgccagcggagctttcccgccacagcggaatccccgggatgggggacggcagcctgagcgccctgcagctggagcagatgaagtattttgccatgctgcggtatgtggacaccacggtggcggaggtggatttttccacgggaagctatcatgtggtatatgcgccggatgaacggattaagaagctgtttcagggagaatgcctggaggctgtggtggactgctatataaatgatttggtggcgactgaggaaaaggactatgtgcggcgtatatggaaattagagataccgcggttctttgaggagggaatgctgaaacagagctggaaataccggctgaaggatgagagagggtctgaggaagcgtgttatgaactgacacttctgcgggtggacattgagcatccgcgccgccgcaaggcacttctgctgtggcggcttttggaaaacctgcagccggaggccaatcccgacgagaagaggctccgagaggaccggcgggtcctccaccaaatattgaagggaatcatacgctgccgcaatgaccggtggttcaccatgatggatgtggatgacggctttctcgggtacaccaggaaggaaataaggaagcggttcaatgaccgctacatggaaatgatacatccggatgaccgggagaggatgcgcagggaactgacggagcagataaaccggggcggggattatgaagtggaataccgggttcaggaccgcagcggacgcatcaactgggtgctggacaaggggcgcctgatgtacgatgccgggggcaaggagtatttttacagtgtaatcattgatattgaccagaccaagcatgcccaggaggaactgcgcctgggactggaacggtataagattgttatggagcagaccaatgacattttctttgaatgggacataagcacggacaccgtggtgtactccaccaactggaagagcaagttcggatacgaccccatctcggagcaggcgtcggtccgcatacctaagatatcccatctgtatccggaggacatggctccttttgggcatctcataaaagagatacgggacggcaggcgatatggggagctggaattccgggtgtctgattccaagggccgctatcagtggtgcaagctgagagccaccacccagtttgacgaccagggagttccctgcaaggcagtgggaattgtcattgacataaatgatgagaaactggcggcccaggaactgaaggcgcgggcggagcgcgataccctgaccagactgtacaacaaggcgtctgccagacagagaattgagcatctgctggcgaaccgggaggacggggaaggggctgccctgtttgtcattgacatagataactttaagatggtcaatgaccagtacggtcatatgtttggggatgcagtgctgacaaagattgcaggacagctttcaggactgttccggagcagcgacattgtctccaggattggaggggacgagttcatggcccttttgcagggggtggtcaatgatgaacgggtgaaggctgtggccggacggctcattgagtgctttgaacgggtgctggaggagctgccgaaggattgttatattacatgcagcatcggtatagccgtatgcccaagggatggggaggatttccagaccctgttccggcgggccgacgtggcgctgtaccaggctaaggcctgcggtaaaaagcagtaccagatttacgaccagtccatggagaacaaggccttcagccagggcgcagggcggggggcaacggtgaatactgccattgaatcggagcagaacggcggtctggtattaaatgacctgctgcccagggcgtttaacattctggccaaatcagaacagatggataaggctgtggaaagcgtgctggagcttctgggggaacggcttcaggtgagccgcgcctacgtatttgagaattcagaggatgggacctgctacagcaatacctttgagtggtgcaaggaaggaatccggccccagaaggacatgatgcaggggtgttcctacgcagagcttaagacggattataagagctgttttaatgagcggggcattctgtactgcgatgatatagggcagcttcccgaagatatccggaaacggctgaagataaggggggttaagtccatgctccagtgcgccatcaaggataacggcgtgtttaagggttgggttggatttgatgactgcacctcccactgtctgtggaccataagccagattgagattctttcctttgtgtccgagctgctgtcgctgtttcttttaaagcagagggcccaggacagtgccgtggatttggcggaggacctgaggaccatactggaccatcagaattcatggatttatgtggtggacatggagagccatgaactgctgtttatcaacaacaagacctataagatagcgccggattcaaggctgggcatgagctgccacgaggcatttttcaacagggataagccctgtgaacggtgtcccatgaaagaggtggaagataaggtcaattacaccatggaggtatataatcctgtccttaaggtctggtcatccgctgacgcttccaggattcactggggcggcaaggaggcatgccttttgtgctgtcatgatatcacctgctataagacagcggaagaaaatggagggaatcaatcaaatgggtgagcagaacgtggaaactggaatattctgacagtagagactgttgtgaagaaggagttccatatgaaacgttgtgtaccgttagagccggcggcagaggaggtctgtcaggccaattccaaaccgccccttatatttgagctgccgccggccgagggaaggctggttctggaaaaagcccaggatacccctgtgtacaaatatccggcccgcaccagcaaggtgcgggtcaatacaggaagatgggggaccattcccgtgtggctggtggacccgggtgtttcctgccagcctgccaatgtcatcttttttatccacggagccggctgggtgttcggaagcttccacacccatgaaaagctggtaagggagctggctgccagaaccggctgcctgttgattttcccggagtattcacgttccccggaggcgcgttatcccaccgccattgagcagtgctacagcgtcatgtgtacggttccggaccttgtgaagtccatgggatataccatgaatccgggaaccttcaccgtggcaggggacagcgtgggaggcaacatggccacaatcatgacccttatgtccaagtacaggaaggggcccttcatccagaaacagcttctgtattatccggttgccaatgcctgctttgatacctgctcctacaatgaattcgcagcgggctattacctgtaccgggcaggcatggagtggttctggaaccagtatgccccatgccagagagacaggggacagattacggcctctcctctccgggcttccagggaacagctgcggggcctgccggacgccatgatactgaacggcgaggcagatgtgctcagggatgagggggaggcctatgccaggaagctgcgcgacgccggggtggatgtgaccgccctgcggttccaggccattatccacgattttgtcatgcttaattccctggaccagacaagggcctgccgtgcagctatggatgtgtccacggaatggattaaccggaagaaccgggaaaagcaataaaccagcaaaccggaacaaaggcggagacagtacggaggtctctgcttttttgtttcccaaggaaaaatggagggtaaggcatgggctggaagaggggccgcaagaagggaagggatgaaaaaaggggaaaaataggcacaaagaggtaaaaagacggaccggaattaccttgaaaatgaacgtgttatattttatactgaaagacagcaattggaaggtgtggaaaaaaatacataagaggggggactggattatgataaaggtttttcttgtggaagatgagattgtcatgcggaacggcattaaaaacaacatcccatgggagaaagaagggctggaattcgcaggggaagccagtgacggtgaactggcctatccgcttatcaggaagacgcagccggacattctcatcacggatatccgtatgccctttatggacggactggaactctcggaactggtgaaaaaggaatttcccagaatcaaaatcatcatactcagcgggtataatgaatttgactacgccaagcaggccatacacatcggggtgacggactaccttttgaagcctatcacagcagccaagcttctggaggcagtgaagaaggtggcggatgtaattgagaaggagagggaggacgcccgcctcatggacaagtaccgactggagatggcggagaatacagtgctggaacgccagcgcctgctgcgggacctggtgacaggacgggtcaattttaaagaggccctggaacggggcgcgcaggtgggcatggagctgtccgcctccttttaccagcttatgctgtttaaactcatgccaatgggttctgctgtcgcctattccgatcgggtggtatcctgccaggaggccattgaggagcggatggagggccgggaacacatactggtatttgaccgcggggacgagggttgggctttcatactgacaggggagtctgagcaggaggtggagcgcaggatgagtgagtgcgccgtcagcctgggggaactggccggggcctataaggacatacagtatttcggaggaatcggaagctgcgtaaaccgtctgggagatttgcagatgtcctatctgcaggcgggacgggcgtttgcagccaggtttttcatggaaatgaaccgggttatcagctacagccagatggacggcatggtccacggctccggggaagccattgatatccactccgtggatgcgtcaaaggtgaacaggaagactctggagaattttctgaaacagggaaccgttggggaggctgccggatttgtggaggagtatttccagaatgtgggagaaaaaaactgccagtcctttatgttccgccagtacattgtcatggattgctatctctgcgtcagcaccttcctggagcagctgggcctggacatggcgcgccttccgcgggaactgtcggacatggaaaaggtccttaaggacaattgtgccctggacatgctgaaggataagctggtgcggctctttgaggaggtcatgaccttaagggacagccagacagccagcaagtacagccaggtcctggacgaggctaaggcgtttatccatgagaattacgccaaggaggagatatccctcaatacagtggcggccagggtcaatataagccccagctatttcagctctatcttcagccaggagatgggggtgacctttgtggagtatcttaccggggtgcgcatggataaggcaaaggagcttttgatgtgctccaaccttaaaacttctgaaatcgggtacgaggtgggatataaggattcccactatttcggctatctgttcaaaaagaccgtgggatgcacgcccaaggagtacagggccggaagcagggagggttcatgaaaggaaaatggaggaccggggccggcaggaaggagtgggacggaaaccgcatcctggagcgcctgcctctggaaaagcgcctgaatctgatgacattcatcatcatcatacccctggcagtgctggtcatctatctcatggccacagtggccaagttctgcaatgcttatacccagagcatcaccaacattacccaggccaacagcgtcacggccaatctgcgggaggatgtggattacagcatgtaccgcattgtcataggcatgcggacctaccagaccatccatgacctgatggaagaggaacggccctatggatgggagcagattaaggacccccatcaggtcgtaagcgatgccaggaagacctaccggcagctgttaaaacggacgccggagggcgccaaccggaccaggattaactggctgcttcattgcctggaccagctggaacagagagtggatgagatagaagacaacctgccccacggtatgtatgataagaacatggaaatcctggattacggcgtccgggtgctgacagcggacatagaaaagcagggcagggagtatgtatactacgagactctgcatgtccaggagatacagaaggagctggagagccaggagcacacggccatagtggtcagcctgaccctgctggtatccatccttctcatcagcctgattctcagccgcaggataaccaagagcgtcactgagcccattcagaagctctgcaatgagacggagagggttgcaaagggagatttcacttccgggcccaagattgaggcgggggatgagctggcaatccttacgggaagctttgaccatatgaaggaagaaatcggacggctcatagaggacatacggcaggagcagaaccagcgccgcgtcatggagctgcagcttctccaggaacagattaacccccacttcctctataacaccctggataccattgtgtggctggcggaggggggacagaaccgggccgtggtggacatggtcacctccctgtcggaatttttccgcacaaccctcagcggcggaaaggatttcattaccatgcgcgaggaaatcggccacattgaaagctatctccaaatccagaaaatccgctaccaggatataatggactatgaggtcacgctggaaaaaaacctggaggagtgcagaatcctgaagcttaccctgcagccgctggtggagaatgccctctatcacggcatcaagaataagagggggaagggacacatctgggtccgggggtatgccagggaggacatggccgtgctggaggtggaggacgacggcgccggcatgacacaggaggagatggaggccgtaaggcgaaagctcagaggggaaaaagaccggcctttacgggaaggaccggctcccaagggcggtttcggactgtttaacgtggcggagcgcctgcggctgaactacggttcccggtgcagcctggaatttcacagcgtcctgggcaggggcacaagggccgtggtgaccattcctctggaggccagagacagcgggccggagataatgggggaaggggagaattgaaaaatatcccaccataatcgtaaaaaaacacccaaatgtatgaacaaactatgaaaattctaaaaatcgtgtacaaaacaacggagaaattccgttgtttttgttattaacaactgctatgattataccaacaaggggaaacaaaatacaaatcaaggaggtttacgtattatgaggaaaaaaggattaagcgttatgttatgtgcagcaatggcagcatccctgctggcagggtgcggcggaaacaagcctgcagagacaacagctgctccggcagcagagacaaccgcagccgcagccgacacaacggcagctcctgagaagtcagaggctgagacagaggcagaggcaaaggatgaagcagcatccggcgatttgattgtagtgggatatgcacaggttggcgctgagtctgactggagaaccgctaatacagagtcctttaagtcaacctttacagaagaaaacggctacaagctgatttttgacgacgcacagcagaagcaggagaaccagattaaggccatcagaagctttatccagcaggatgttgactacatagtagttgcccccgtggttgagaccggatgggaagcagttctccaggaagcacaggaagcaggaattccggttatcctgtccgaccgtcagatggacgtggatgaaagcctgtatgagtgctgggtaggcggcaacttcatcaaggaaggcgagacagcaggaaactggctggctgattacttaaaggcacagggaagggacggcgaggacatcaacatcgttacccttcagggaaccatcggagcatccgcacaggttggccgtacagaaggtttcggaaacatcttaaagcagcatgacaactggaaaatgttagatatgcagaccggtgaattcacacaggctaaaggccaggaagttatggagtccttccttaagtcctatgataacattgatgtggtagttgcagagaatgacaacatggcattcggagctatcgatgcaatcaaggcggccggcaagacctgcggacccgacggcgacatcatcatcttctcctttgacgcagttaaggcagcatttgacgctatgatagcaggcgacttaaacgcagcatttgagtgcaacccgctgcacggaccgcgtgtagatgaaatcatcaagaagctggagaagggcgagaccgttgagaagattcagtatgtagacgaggcttacttcgatacatccatggatttggaatccatcaaggctgagcgcgcttattaatcaacattttcgttacagttcaggaaaggcggtggggagagtcgttgcacggctctccccacttttcaagcccgggactggatgtattctggcaactgagccctggaaatggggcgaattacggtagaaaggcggaaatcgcatggagcagaacgttgttttggaaatgcggggaatcagcaaaaatttccccggtgtaaaggcactgcaggatgtggattttactttaagaaaaggcgaaatccacgcccttatgggtgagaatggtgccgggaagtctacattaatcaaggtgctgaccggcgtggaggagtttgagaccggtacaatccgaatggaaggttcatccgataccatcgtcaaccggtcgccccaggaagcgcaggagaatggcatcagcacggtttaccaggaggtgaacctgtgccccaacctgtccgtggctgagaatctctacattggcagggaaccgaaaaaggggcccatgatagactggaggtccatgaaggaaaatgccaggaaactgctggaaggcctggacatccgcattgacgtgaccatggcggtggagaactattccctggccatacagcagatgattgccattgccagggcggtggatatgtcggccaaggttttgattctggatgagcccacatcctccctggacgacggtgaggtggagaagctgtttgtgctgatgcggcagcttaaggccaagggaatcggaatcattttcgttacccacttcctggagcaggtatatgctgtctgcgaccggattacggttctcagaaacggcgccctggtaggggaatttaaggtggaggagctgccgagggtgcagctggtggccaggatgatgggcaaggatttcgatgatttggcagccatcaagaaggaaggcgtgtccacggtcaaggaggatgtcatcataagcgccaaagggctggggcacaagggtaccatcaaacccttcagcctggatatccataaaggcgaggtcatcggccttacagggcttctgggctcaggccgttctgagctggtccgcgccatatacggcgccgataagccggacagcggcgagctggaggtaaagggaaagatgctaaaggtcaatgcgcccattgacgccatgatggaaggcatggcttacctgcctgaaaaccgcaaggaggagggcatcatcgcagacctgtccgtgagggagaacatcatcattgccctccaggccaagaagggcatgttcaagcttatgagcaggaaggaacaggaggaattcacggacaaatacatcgacatccttcaaatcaaaacagcggacagggaaactcccatcaaacagctctccggcggcaaccagcagaaggtgattctggggcgctggttgctgactaatccggatttcctgatactggatgagcccacaaggggaatcgatatcggtaccaagacagagattcagaagctggtgctgaagcttgcagaggacggcatgtccgtggtgtttatttcatcggagattgaggagatgctgcgcacctgcagccgcatggcggtcatgcgtgacggcgagaaggtgggagaacttaaggaaaccgagctgagccaggattccatcatgaaagcaattgcgggaggaggggaagaataatgggaaaacttaaaaaactgacaggttacaggctgtttctcccgctgtcctgtcttatcatagtactgttaatcaatctgattaccacacccacgttttttagaataaccatcaataacggcgtcctctacgggtatatcatcgatgtcatcaaccgggccagcgagctggtggtgctggccgtgggcatgactctggtggtgtccgcctccgccggaaccgatatttccgtgggcgctgtcatggcagtggctgccgcagtgtgcaccagggtcctggcaggcggcgaggtgtctgtcaatgaatatgccaatccctacatcctggccgtgctggcagccctggcagtggcggtggtgtgcggcggctttaacgggctgctggttgccaagcttaagatacagcccatggtggcaaccctgattctgtttaccgcaggcaggggcatctcccagctggtgacaaacggtcagattacctacatccgcgtggacggatataagctgctgggcaacaacataccgggaatacccattcccacccccatctttgtggctgtaattgtggtggtcctcacctatgtgctgctgaagaaaacagccatgggcatgtacatccagtccgtgggcatcaatgagagggcgtcccgcctggtgggccttaaatcagtgaaaattatctggctggcctatgcattctgcggactgtgcgcgggaatcgccggactggtggcgtcttcccgtatctattccgcggacgccaacaacatcggcctcaacatggagctggatgccattgcggcagtggccttaggcggcaactccctgggcggcggccggttctccctgctgggctctgtaattggcgcctataccatccaggcactgaccacaaccctctatgccatgagcgtgcctgcggaccagattccggtatacaaggccattgtggttatcctgattgtagctgtacagtcggatgagcttaagaagttcagaaagcgtttggctgccagacacacatccaaaaacgtggaaggaggagtggcataatgaaaaacagaagtgaaaagaaaaagctggacggcaactccttcctgctggctgtcaccatcatattattctttgtgatgtacatagtgggcatcatcatgttcggcggaaggggatttgcaaaggtacagaacttcctgaacctgtttatatccaacgccggcctgattgtggtggcaacgggcatgaccattgtcatgattacaggcggcatcgacatttccgttggctccgtggtggccatggtgtgcatgatgctggcctggatgatggaaaggggaaacatcggcgcatttcccgccatctttatcgtgctggttaccgggtgcatatttggtctggtacagggatttctggtgtcttaccttaagatacagccctttatcgtgaccctggcaggcatgttttttgcgagaggcatgacatccattatcagccaggagatgattagcattaccaacaagacatttaccggtattgccacctttaagatgtacctgccctttggcggctatctgaataaaaagggggtcatgatttacccttacgtatacccaagcgttatcattgcccttgtggttctggccgttattttcgtggtccttaagtataccaagttcggccgttctatttacgccatcggcggaaacgagcagtctgccctgctgctgggtctgaatgtaaggcgaatcaagcttcaggcgtatgtgctggacggattcctggcagggctgggcggacttttgttctgcatgaacacatgctccggcttcgtggagcaggccaaaggatttgagatggacgccatcgcttcctccgttatcggcggaacccttctgacaggcggcgtgggaaatgtcatcggaagccttttcggcgttctgattaagggcaccattgaatccttcatcaccttccagggcacgctgtcctcctggtgggtgagaatcaccattgcagcccttctgtgcttctttatcgtacttcagagcctgatagcagccctgaagagaaagaataagtaatgacggctgaaaatgtaacaaatcattgaatgtaacaaatcatcgtgccagcaagcgggccgtcggcttgctggcatttttttgcattgggggttggtatttcggatatattcacatgggagaaagaaggtttctggtcgaaaatgggtaaaatgttgcataagttgtacgtacaagaataaaaaatataaaaaagtaataaatacctattgacaaatgaagaacaaaaatgtatagtgtatttaaagaaaaacgtaagaaaaattgacgaaacccacaacacaaactggataaaaactgcgaaactgcaaattaatccaaaatgaccggatgaaacaggacaaggcttagctgaattaacgaaagtacaagcttgcaaacatgtatgcaagttgtatgtataaattaaaccatgggaggtaacatatgaaacgaaaaattttaagcatgattctggggacggcaatcgcggcttcactgttaacaggatgcggcggctcacagcagacatcagtaaccacagcggcaggggacaccaccgcggcagcggcagattccaccgcagcagctgatgcggctaccgaggcagccaaggcagcaaccggcgagggccagaaggtaggcgtggccatgccgacacagtcatccgagcgctggattaacgatggcgccaatatgaagaagcagctggaagcccttggatacgaagtagaccttcagtatgcagaggacgatgtacagatgcaggtttcccagattgagaacatgattgcatccggcgtcaactgcctggtaatcgcatccatcgattcctccgcacttgtaaacgttgaggagcaggccaagagcgcaggcatcccaatcattgcttatgaccgtcttctgatggacaccgacgcggtttcctactatgcaacctttgacaacaagggcgttggtaccgcaatcggcaactacataaaggaagccaaggacttagatgcagccaaggcagccggagagtcctacaccatcgagttctttatgggctcaccggatgacaacaacgcgctgttcctgtacaacggactgatggaagtccttcagccatacctggatgacggaacactggtatgcaagtccggacgtacatccttcgaggatacatgtatcctgagatggtcccaggaaacagcccagcagaactgtgagaactatctgaccggattctatgcagacgagaagctggacatctgcgcaagcgcatttgacggtttcgcatacggctgcaaggcagcgctggaaggcgccggctacaaggttggcgaggactggcctctgattacaggacaggatgcagagctgatggcagttaagaacatcatttccggttaccagacagcaaccatctacaaagatacacgtcttctggctgagaagtgcgtaaccatggtacaggctgttctggaaggcgctgagcctgaaatcaacgataccgaacagtacaacaacggcaaggttgtggttcctgcttacctgtgcacaccggtggcagtagacaaggacaactataaggaaattatcgtggacggcggctactacacagaggagcagctggcacagtaaagatgattcgggcggcggcatgggtgccgccgtccgattgcgcttttacagagtatctttcaagaaaaggagttgaaaagatgtccgattatattttggagatgaaccacatcacgaaggaattctcgggcgtgaaagccttggacgatgtcaatatcaaggtaaaacgcggtgagattcatgcgctgtgcggtgagaacggggctggaaagtccaccctgatgaatgtgctgtccggcgtttacccctttggttcatacagcggggatatcgtgtataacggcaatgtgtgtcagttccacagcatcaagcagtctgaggccaagggcattgttatcattcaccaggagctggccttaagcccatacatgtcggtggctgagaacgtgttcctgggaaatgagcagaaggcggccaagggaatcatcgactggaccctgacccataaaaaggcccaggaaatgcttgaaaaggttggactgggcggagaaaacctgaatgcgcccatcagcagcctgggcgttggaaagcagcagctgattgagattgccaaggccatggccaagaaggtggagctgctgattctggatgagccaacggccgcactcaacgatgaggagagccgccggcttctggacatcatgctggacctcaaatcacatggaatcaccagtatcatcatctcccataagctgaacgaaatcagttacgtggcagattccattacggttatccgggatggaaagaccattgagactctggagaagggcagggatgattttacggaagaccgcatcataaaaggcatggtgggccgtgagctgaccaaccgttacccggaacggcactgtgaaattggtgatacgattttcgagataaaaaactggaatgtgtaccatcccgacgatgcccagagacagattatcaaggacgtttcccttcatgtgcgcaaaggcgaggtagttggcctggcaggactgatgggcgcgggccgtaccgaactggccatgagcgtattcggcaggtcctacggacagaaaatcagcggcaccattaagataaacggaagagaagtacatattaaggatgttaaggacgccatcaacaataagctggcgtacgtgtccgaggacaggaagaattacggacttgttcttatcaaggatatcaagtggaacatgaccctgtccgccatgcggaatttcttttccaaaaacggcgttctcaatgaaaatgatgaaattctggctgcagaggattacaagaagaaaatcaacatcaagtctaattccattaaccagaccgtgggctccctttcaggcggcaaccagcagaaggtggttcttgccaagtggatgctgacacagccggatgtgctgattctggatgagcctaccagaggtatcgacgtaggcgccaagtatgagatttactgcgttatcaatgacctggcaaaggcgggcaaggcagtaatcgtcatctcctctgagatgcaggaggtaatcggtacctgtgaccgcgtatacgttatcaacgagggacggattgcaggagaactgaccagggaagaggtcacccaggaacgaatcatgaagtgtattatggcggataatggaaaggaagcgtagagatggataagaagaaaacagttaatattgatatgaagcagtatggcatggtgcttgctttaatcgcagtgttcttgattttcgcagtcatgaccggcggaaagaacatgtcgccggccaacatcaacaacctaatcatgcagaacggatacgtggttatcctggcagtcggtatgctgttatgctgtctgaccggcaacattgacctgggcgtcggctccatcgtggccctgtgcggcgcaaccgtgggtatcctgatgattgactaccacaccaacatgtgggtggctatcctggctgccctggcagtaggcgccctggccggtatgttcgtaggcctgttcgtatccaagctgagcatcccgcctttcatcgtgaccctggcaaccatgcttatgggacgcggacttacatacaccctgttaaaggcgcagacaaagggacctcttcccaccaattatacctatatcggcgcaggcttcctgcccaccatgaagattccctttggaaacggcactctggacctgatttccattattgtggcaggcgtagccacggttctggtggtcatggcggagcttaagagcctcaacaccaagaagaaatacggttttccaaccaatccgttatggcagaccattgtaaaggaagctgtcatactgatgattgtatggttcttcttctacaagctgtcacgctacaacggcatcccctttgtattggttatcatgggcgtactggtgggcctgtatcatttcatcaccagcaagaccgttgcaggacgccagatttacgccctgggcggcaatgccaaggcggcaaagctttccggtatcaacacagagaaggtattcttctgggtttacaccaacatgggtatcctgagcgccattgcaggtattgtgctttccgcacgtaatgcgtccgcaacccccaaggccggcgacggtttcgagatggatgccattgcctcctgctacatcggcggcgcagctaccagcggcggtatcggtacgattatcggagccgtagtaggtgctttcattatgggtatcctgaacaacggtatgtccctctacggatggtccaccgacatccagaaaatcgtaaaaggcgctgtacttttaggcgctgttacggtagacttattatcaaagaggaaaaaaggataggttttgattatgagtacacaggagctgaaatatagagcagtttataactgggtgttggacaacattaacagcggagctttgaaggtaggcgaaaagctgccttcggagaatgaactcagcgagcgtttcgggctgagccgccagacggtacgccatgccgtggatatcctggagcagcagaagctggtattaagggttcggggcagcggtacctatgtgggcggcaacggcaaggcggaacgccaggaacgttacatgaacatcgctgtaatcagtacctatgtggacagctatattttccctcctgtggtgagaggaatcgagagagtgctctccagaaaaggttataccacccagattgcctttaccggcaaccgggtgagcagggaacaggacatactgaataatcttattgataaagacatcatagacggactgattgtggagccggccaaaagcgctcttcccaatccaaacctgcattactaccaggaactcaaggaacgggggattccgattctgttctttaacagccggtacccggagctggagctgccatgcgtgtccatgaacgatgagcaggtgggaaaaaaggcagtggaatatctgattaagaacggccacaggagcatcggaggcgtgtttaaaagcgacgacggacagggccatttgaggtacaaggggttcctgtccggtatgctggaggcaggcatcaaggttaaggatgccaatgtggtatggctggacacggaagatttcctggacctggaccagtggtcggattatctgttccgcaggctggaaagctgcacgggcgtggtatgctacaacgatgaagtggcatacgtgctgtccgggctctgcgagaagcggggcattgccatcccggaccagctgtccattgtcagcattgacaactcggacctggcaaccctggccggcgtgaagctgacctccttcccccaccccatggaggcgctgggcagaaaagcagcagagaacatgataggtatgattgagaatccctactttgacggtaattatctgtttgactcggatatcattgagcgggattcggtaaaggtcctggaggggccccataaggaggaattataatgggtgcaaagaaagacaaaaatgccgaaaaaccggctcagataaccgtaatactgcgtctggctgcaggaggctacctggtatacctggcctttggtctgctgcaggagtatttgaagcctgccggcggaggcaggatggtacagattggctgtgcggtattctttggcatagcaggcgcattcctggccggctggtcccttaagaaattcataaaaggcgagtatgttaaatacggcgagattccggatgatgacgaggaagagcagacggatgatatttagcagcatttaaggaggatgagagatatgatagcagtaaagaattataagttctggttctgtacaggttcacaggacctctacggagatgagtgtctggcacatgtggcggagcattccagaatcattgtggacagtcttaataaatcaggcatcctgccctatgaggtggtgtggaaacccacgctgattaccaatgagctgatacgcaggaccttcaatgaggccaatgcggatgacgcgtgcgcaggcgttatcacctggatgcatacattttcccctgccaagtcctggattctgggactgcaggaatacagaaagcctcttatgcatttccatacacagtttaaccaggagattccctacgataccattgacatggatttcatgaatgagaaccagtccgctcacggggacagggaatacggccacatggtgacccgcatgggcattgagagaaaggtcatagtgggacactggagcgatgaaaaagtagtgggccgcattgctggctggatgcgcaccgcggtgggcatcatggagagcagccatgtacgggtggcaagattcgcggacaacatgaggaatgtggctgtcaccgagggagacaaggtggaggcccagatgaaatttggctgggaagtggacgcttatccggtcaatgagctggctgagtatgtgaaggctgtgcccaagggagatattacggccctggtggacgaatactacagcaggtacaccatcctgacagagggcagggacccggaggagtttaagcgccatgtggcggtacaggcccagattgaggctggccttgagaagttcctgctggacaaggattaccacgccattgttacccattttggggatttgggagagctgcagcagctgcccggcctggctatccagcgcctcatggaaaagggatacggattcggggcagagggagactggaagacggcagccatggtaagactgatgaaaatcatgacccagggcgtgaaggatgccaaaggaacctcgtttatggaagattatacatataacctggtgccgggcagggagggaatcctggaagcccacatgctggaggtgtgccccaccattgcagacggggaaatcagcatcaaggcatgcccgctgtccatgggcgacagggaagacccggccaggctggtattcacatccaagacaggccatggaatcgccacatccttagtggacctgggcacaagattccgtctgattatcaacgatgtggagtgcaggaaaacagaaaagcctatgcctaagcttcctgtggcaactgcattctggacaccggaacccaatctggcaaccggggcagaggcgtggattctggcaggcggcgcgcaccacaccgcattctcctatgacctgacggcagagcagatgggagactgggcggacgccatgggcatagagacagtctatattgacaaggataccagcatccgcgggcttaagaacgagcttcgctggaacgcggctgcttacaggtaggattaggaacaggatatatggggcggaccctgggggcatgtgttcaacgtgttcttaacggcccgctccttaatgagcaagtggaggggaattcatgagtttagatataaatagcataagagaacaaattgagcatggaaatacttccctgggcatagagctgggctccaccaggattaaggcggtcctcatcggcggggaccacacacccattgcctccggcagccatgactgggaaaacaggtacgtggaccatatctggacctataccctggaggacatctggaacggcatccgggactgctacggtaagatggctgaggatgtacagaaaacatacggcattaccctgaccaccattggttccattggtttttcagccatgatgcacggctatatggcatttgacaagaacggagagcttctggtgcccttccgcacctggagaaataccattacaggacctgccgctgaaaagctgacagaggtattccggtacaatataccccagagatggagcattgcccacctgtaccaggccattctcaataaggaagagcatgtgaaggatatagattatcttatcacgctggagggctatgtgcactggaaactgaccggcagacgcgtcctcggcatcggcgacgtggcaggcatgtttccggtggatatccatgccagggattttgaccagaagcgtgtggagcagtttgatgaactggtggcaggggagaatttcccgtggaagctgcgggatatcctgcccaaggccctggtggcgggagaggatgcaggcgtcctgaccgaagaaggcgcaaagctgctggatgtgtccggaaacctgaaagcaggcattcccatgtgtccgcctgagggcgacgcgggcaccggcatggcggccaccaacagcgtggctgtccgcaccggcaatgtgtccgcgggtaccagcgtgtttgccatggtggtactggagaaggagctggagcatgtgtatccggagattgacctggtgaccactccggcaggcgacatggttgccatggtgcactgcaacaactgtacatcggacctgaatgcatgggtgaacctgtttaaggagtttacagaggcaatgggcgtgaaggcggacatgaaccagctttacggtaccctttacaacaaggccctggagggcgaccctgactgcggcggtctgctggcctacaattatttctcaggggagcacattacccactttgaggaaggccgtcccctgtttgtgcgcacgccggacagccggtttagcctggcgaatttcatgagggtgcacctgtacacctccttaggcgcccttaagacaggcatggatatcctgcttaagcaggagcatgtgaaggtggacagccttctgggccatggcggcctctttaagacaaagggcgtgggccagagaatcctggcgggagccatgaacgcgccggtttctgtcatggagacagccggggaaggaggagcctggggcattgccctgctggccgcctatatgaggtgcagggaagagggcgaaaccctggacgcttacctggcagacaaggtctttgcaggagacaagggaaccagaatggagcctgtgaaggaggatgtggaaggattcgaggcattcatgaagcggtatgcagagggccttgccattgagaaggctgctgtggagcatatgaaggattaagctgtgagcatagaaggattaacaggaacgggagcggatacagactatgttagaagaactgaaacaaaaggtatatgaagccaatatggagctgccctgcaggggcctcatcacctacacatggggtaatgtcagcggcattgaccgggaaacgggattgtttgtcataaaacccagcggcgtggattacgatgtattgaagccatctgatatggtggttatggatctggagggcaataaggtggagggggagatgaatccttcctctgacacagccacccatgtggagctgtacaatgcatttaaggagataggcggtattgtccatacccattcccctcatgcaacggcctgggcgcaggcgggcagggcccttccctgctatggcaccacccatgcagactatttttacggtgagattccctgtgccagaaacctgacggcagaggaaatcgaggatggctatgagaaaaatacgggaagggtcatcatagagacattccagggtaaaaatccggtttatattccggctgttctgtgcaagaaccacggtccctttacctggggaaaggatgcggctgaggctgtccacaatgcggttgtgctggaggagattgccaggatgaatttcatgacggaacttatcaatccccaggcagggccagctccccagtgtatgcaggataagcatttcatgcgcaagcatgggccgaatgcttattatggacagggaaagtaaatgataccggctgacgcctggctgtttagcaggcagatgaatgtgcgaaatatagtaagaaggcccgcagaggcagtccccgggttccggggatttggttactgttcagaggctaacttgtaaagaaagaacccatggtgtagactggaagcgcttccagtctacaccatgggttctttctttacaagttagcctctgaacagtaacgattccgattcagggttatgattcattgcaagaactgcttgccatcctgcccgactatatgatataattagtttcgttggagacatagctcagctgggagagcatctgcttgacgtgtagagggtcgcaggttcgagtcctgttgtctccatgtgccgaaagtgccggaatcctttatttcaaagggactccagcacttttttgattgtttactgtttggacttttgaatacacctgggtctgttgagaaaatgaagttttgtttttctctccccatattcattacagaaaatacattcagaaagcatggttctattccctttaatcctcctaatctccccttctgtacccaatcgtcctaagcattatgcggctcgatatccccgacagttatatggaggtcaatcataactaatgaaatcccatgttggaaacccgtcttaatgggttggaatttcaaaccaatttgccaatgctgtgcaaaatcataagccctaaggttttcattcatcctatccaaccatgttttttctgagttctgctgcctttgcaaaaataaggtttctctgccaatccggcaaatcatcctgacgcttattcagggccttatgtttccagattccgtgctctacctgcttataataggattcagaatcgccctggaaatccatatcccatacctctgatacaatctgtttagactccccatttatcagtacaatcgcatatcccgaatctgttttttcacatatgcaggtaacctcctggctgctttctgcatcaaaagcctgctgccatttcagcaggacctcttcacgtttacgcacaagcatgtttatctgctctgtgacatctttcagctgctgttcacattcttttaaattcatcctctgtccctcccatccgttattaggtactcagtatagcatattgcctgttaaaaatccacttgcatggcgaatcattaataatcttatggcgggtattctttccatggctcacagccaaatatcattaccatctcactttacttttgcagcattgctgccttctgctgcccatattatcagatttgacacagacgcaggcgtgacagcagcctcatttgatatcggcagcaaatagcgtttccagcatcccttttcaccatatcagaggctgcagtggtaccctgaaaaatggtttcttctctgtatccgtcgccgactctgcctgtacaattgcctccataaccctgaccggcgtcattggaatttcatacatcgcaaggcctgttgcatccaatactgcattccttattgccggagctccgcctagaatcgttggctcccctatccctttggcgccaaatggccctaaatcactttcagattccacaattatggattctaaatgaggtatatccatggaagtgggaatcagatattcatgaagtgaagcttctttaaccattcctttccttaaaaaacactcctccataagtgcccacccaaaagcctgtgcagctccgccatccatctgtccttcgacggtatccgggttaattgctttgccaacatctgttgcctgtacggatttacacacagtaatcataccatttctagtatccacttctaccatgacgccatgagccccatatgcaaatgttacccaccgcgtagtctgattccgattattgatatccttttcagtcatgggtggataccagtttcccacctctgccaacggcacctgggaaacccttgctgctgaaacaactgattttaatagtattcttttttctgaatccttcttagaaaatatcacaccgtcttttatagctaattcatcggcatattcctttaaaatgcctgatgcaacatccagcattctcttcttcaatgaatgacaaccactgataattgcatttccctgaaatacagttgctctcgatgcagatgtgggaccagcctcaggcgcacacatggaatcagatatccctatatttacatcttctatggaaactcccattgcttctgcagctatctgactcattgcagcaatcagtccctgccccatctcattctgagccacatttacacttaaggaaccatccagatttaactccagatatacatgaccggcatcctttggaaatgaacttccagtgccatacatatagcatgctatgccccttcctcgtttgatatatggattcgagttatccaaaggcttgtcccaatctaatgcattcctcactttctcaatacattgccgtatacccgacacatcatttttattcattttctgagaaaatatagtagtagaaccttctttaatcaaattttttagcctgaattcaatcggatccatccctattgttcgcgccatatcgtcgataatgcactctaaggcatactgctgttgaggcgcgcctaatcctctgaacgcgccgccgtaaacatgatttgtatataccgaccggttcctgacattcacaactggtattgaataaggcccccctgacagcagcgcagacctatgaggaattacatccactgatttataagcacccttatcgaaaattgcttcagactgcatctcagtaatacatccctcctcatccacaccaagataatatcttatgtaactacgatgccgtttactggtataacgaaatacctcttcccgtgtcatttcatacacgaccgggcgtcctgtaaaaagcgccagaactccggcaaccacgccgcaatccacggacgaacactctttcccgccaaaaccgccgccaatcagagggctgattacccttatcttgctgacaggcaaattaagcgcttcgcatataccttcccgcataccatgcacattttgcaccgggcaatataaggttaatccaccattcatataatccggttccgcaattgcgatatcccgttccaatgatgcgtgttctacaataggtgtacgaaaatctgcttttatttcacatgcggtttttaaaaaggaattctccatgtcgcctctttcgacccgcacatcatttgatacatttccacactttgcggcggcatactcctttctcaccaattttgcttctggacaaatattcctgcaggggtttgtctcccacggcagaacatcatactcaatgcttatcagactgacagctttgttcgcggcctcttccgtttctgccgctacaaaagccaatgaatcacaatcacatactatctcaccttttgccaaaattggcttatccttaagaatatatccatatttaggactgtcaaataaatcatcagccgtcaaaaccgcaataactccaggtactttcttcgcttcatctacatctatcgtttttatgcttgcacatgcacaatcaatccggcaaacttttgccacaagcacatctgttctccccgcaatcaaatccgcagtatactttgcatacccagtcaccttgcttatactgtcaggtctgttatatctctgtccaatatatgactcatttaaaatcacttaacttcctcccaactgtggtttgcagtctgcagccttctctctgctgccaatttaacagcgttgacaatcttttggtaacctgtgcaacggcatagatttcctgatattgccattcttatctcctcatcaccgggattctctttctcctccaacagcgcataagctgtcattatcatacccggtgtacagtaaccgcactgcaccgctcctgcatctataaaagctttctgaagcgggtggagatgccagggcgtacccagcccttcaattgttaccacattcttcccttctgccatgcaggtcagatatgcacaagaacggactgccatattatcaatcagtaccgtgcatgcaccgcagtcatccgtattacatgccttctttgttcccgtcaataaaaatcggttacgtatagtatcaatcaatcgttccgtcccgtctacctcaatgcatacagtcttgccatttaaattaaaatgtactatgggcataatgcaatatcctcccttgagtttctgtaaaagccatatgtacagcctcagcaatcgcataacaggtggtttcttctttgtactttttaaaataactttctctcagtcctgcttcccgcggaaaaaacttcataataagactaactgcatcatctcggtttaatcccacaattctgtcttcgacgctgggcgccagaactgctgttgcatttagcgctcctaatgatatagaagcaccctcacattggcctttcttatctattgtaatgacagcaccagctataatcttagcaatatcctgggactttctgcgtgaaaatctggcgtatccactgcctgtattacagcccaaacttggaaaacgcatctcctttattatttcatttctctttatatcagttttatatgcatcaatataaatatccttttgcttgacgatacgttccccccgtgaacttaccagtaccaattctgtgttgagagccaacagcatggacgcgcagtctgctgaaggggcagccgttgcaatgttgccagcggctgttgcaactgaacgtatggccggacttccgatacagctcactgatttaagcagtcccccaattttgttgcacacggctgaaatctgaatttggcgataagtcacattaccgccaatatgcacatactgaccatcatccgcaatcgtgttcatactttttatattgcgtaaatcaatgattcccgtgggctgtatttttccagccgaaatactcggtatgatatcagaaccaccattcaccagcactgcaccttcattctcctccaaaagtgttacagcttcttccaggttgtccggatgaaaatattttgtttccatgaagccattcctttcttttgattcccgatatcagacgggctgcagacttttatcatcctgcccgcccgccgtacacattaaaacaagcaaaaacaccccaccaaagcagaatgtttttgctgtcatgctacaattcaatccttccgtcaagtatatctgccacagagccgctgtccactgcccatcctaaagacgccttgatttgttttatggccagttcatggtaatcctttccattcatgcttgcacagcagtcctcaatgacaatgacgctgtaatcccgattatatgcctcaaatgcggtacaaagcacgcaattattagtatttgcaccagcaaaaaataatgtatcaatccccatcacttttaaatacatttcaagtggggtacccataaatgcactgtacctctgtttatgaactataatatcattattcgttgcaccaagctgcggcataatctccatggcaggtgaattctcagtatttacaggccttcttatatggcctccaatgcttattttcttttccatctgatatcgccagaaaggacttgccatagacatagtctctcctgtcagagggtttatcttatgacctgttctcacaaatatcacaggaagattacgtattcggaactctggtatgacttttataagaccctcaagtacccgttcgcaatcatcctccggcaccggaagatagttaaaatcataatcaaaatgtgcccgggtcacatcaacaacaataagtgcagcctttgaactttccatatgctaactcctttatttctattactcaaccaacagattcggaaggaacatggataaaccaggaaacagtgtgataattacaagtactactattgtcaacattataaaaggcattgaagaccttacaatctctacgaaagacaatttcatcaccttagtgcttacaaacagatttaatccaaagggaggcgtactcattcctatcgctaaattagtaacaacaacattccccataaaaatagggtctattccagcctttaacgccaactgatacaccataggcataattatcacaattgaggatcctgctcccataaacatacctgcaataaggaacattatatttatgaccagcaatatcatcaatctggatgtactgcccagcatcgcctccataagctgaggtattcgtgcaagtgtcattacataccccagaagctgacctgccgcaagcaatatataaattgtacataccgtttttgcacaatcaccgcagatatcaatcagcatcttaaaatccacatccctgtatataaccatttccacaaaaattgcatacacagcagatattgccgcggcctctgttggcgtacaaataccggtatacattgtaccaataataataatcggaagcccaagtgcccaaatagagtcctttactgcaacacagaattccttaaaattaatcctgggaagcctgggcaccccatgcctgcgtgcatagatatatacgtatactgcaaacacagtcgccataattatgccggaacttaaacctcccatgaacagcttaagtacagatgtattggtattcattgcatatactacaaacgctataccaggcggaatcagcatccctaccgaactaacagtacaaataagtccggcgctgaatccccggggataaccattgtcaatcatttcctgataaatcagggccccaataatcaatatgcccgctgtagatgcgcctgatatcgcacctattattatacagcacacaattgccgtcataccaataccgccgtacatatggcctacaatactccgacagaacttcaataaccggctgcctatctggcctttccccattacacttgccgccaaaataaagaatggcagacatagtgtagaaaacttattaagacctgctgtaaatgacgataccgccattatcggctgcatattaagcacatttaataaataatatgtactgggtatcatcatagcgataaaaattggtataccaaggaatagacatcccaaaagagctataataaacattcccgcagtcattagttcccccttcccccattacatggtttcaagcttgtccaggtcttccatttctatgtcatctttctcttttatcttccctttcctgaagagaacaaatatcgtcttaaaatactcaacagccattagaccgcatccaatcaaagttccaagatacatccaccacatctgaaaccacggcatcgttacactggtacgggcggtcgccttaattgaaataacttccagataggaaaaataagcaaatatagccagaaataccgttgaaatcacagcaagcaccatctggtaatatggatgtatctttttaggaattatattatatataatatcaacactaacgtgctcatgtttttcaacactgataacaccgccaatacatgctacccataccataatatattggcagagttcttctgtccaaggaaaggagtagccaaaaaaattctttaatattattcccagagtaactaaggaagtaacgaacaatatggataacgcgcaaaacgtaagttcaaactttttgaaaaccacgtcaaacgccctatacttttcaattgttttgttcataaaatcatatcccttctgtccatcatcttagcaagccgatacctcgcttacagaagcttatataaggtattgggctgccgcttttgcaattgaaaaattgtttgagcgacagcctaccaataaattatcagttaagctttgcaatatcagcattgaatgcatcaagaatcttttgacctgcttcgccgttactctcaatgtaaagatcaagacaaggctgacggcatgcgtcagacatcgcctgtaattcttcctcggtaaggttgataatttcacattgcgccccaatggcatccaatgcagtctgctctatgtcacttctaactgcctgataagcatcatttccagcaacatttacagcgtccatgaccaattgcttacactcattatccaggccgtcaaaccaggctttgttagcaaataccagctgagaagcaagaatatggtttgtaatctccatatatttctgtacttcataaaacttcatattgtaaattccagctcctattcccgcttcctgaccatcaatggccccggtctgcaatgctgtaaaggtttcctggtaatcaattgtaagcgctgttccccccaaagattcaataaacttcataagaacaggagaagccattacgcggaattttaatccattaaagtcatcaggagtgcgcaacggtacattactagtaaacgctttgaataaatccacccaataccccaagcctaccatatcataatcctgcatagtatccagtaaagtgtctgctgcttctgtcttaaatactgcgcgcgccttttctatgtccggagggaaaaaatatggaacatccagaatagaaagcaggggattaaatgcacatacgtttgcaggaggctgtacacacatttggattccaccattctgtacggactcaataagagtatttgaatcccccagctgaccagccggatatacatctacttgaatctttcctccggaagtttcttcaatatacttttcaatcgcaagagcaccgtcctgtctcgcatcagtggctgcacctgaatgagccaaaataattgtcatctcagggtattcataatctgtgacagcttcggtcgtctgtccttctgtagcatctggctcctggggggattttacttctgcagatgtctccttcacagcaggagccgcacaagcgcatacggaagacatcatcgctgctaccaacaatatacataagaccttcttcatactattacctcctcttttatcaaatcaattgccttaccaccgctcatgaataaccttcttgactgccagattctctggctttcctttcgtcagcgcctcacgtaaccagtctatcgcccatgcaaacagctcatgatacatacctgcacaggaatgaaactcgccctccataatccacatttcctttggacaatccagcatattaaagaaccgttccgtaagctcgggcgggcacatctcatcaaactcgcctgtagacataaggaaaggcactttcaatttatccaccacccgctcaagggtcatttttcctacaaactcatcaaactgttcgtcatcatatatatcacacatatacttaaagttattgcgaagacctggctgacaggaattaaactgcaggtctttctccagatagcatcccagcagtccaacaatggccttaattctggaatcatgcgccgcaactgtagggccatagtatgaccccatgctgccgccaaaaactccgatttgattcggattaacctcaggacgtttacaaagccaatctaaaaacagggaagcggcttcaggaaaatttgtaagcgtcacaggcagaccgtgaacgcgggtttcaccaaaaccaggaccgtccattaccagcacacacatgtttctgcgtacaaaaaaattatcgttcagatttggataatcctccttaatcatatccattcctggagtaaacaaaaccgttggcagattcacagcttctttcggcgcatggaaaataccgtaaatattcttaccgttaaaaggcagcacaacacgttcaattgtgtagtcataaccagctatggccttttcatagcaccgtacgcatgaggcatgaagattcaatttcattgcatcatctttgtggtgataaagctgtgccttgccataataaagagctgcacgatgataaaatgcaccggcagtaaccacacttccccttgcagcagcttcgtcagctaacttttcttgctgctcagccacagcgcaccatgctttaggcatagcccgcaaacaggtcatgcgcctgtttgccctttgtatgtcaacatgcttgaagcccttttcttctaaccccatgtttgcattaggcatgaaagcttctatgccaagctgacctacaaacttgttacttatccaactttcgttttgtctgtacttcgacattctttacccctcctttatatttttactccggtatgagccaccccgcccaaaaccgtataaagcatctgcccccatatgagtattttattatactatatataatccttcagcaaatctaccgcttcactcacgtagctcatcacacgattgtatcctctcatcagttgggtacgaagaacaaaatacctgtatgaggccttatcgcaatccgcaagacggacaccatcgctaagggatggaattggatacattgctcctgaaaggtcaaaatcaaaatggttttcaccatggaaggttatgcgcacgattttatgcgaaagttttagcagcatagtattaatattttctgcatcttcaatagaaacttcattattttctattcgattatacagattatccaacctgcttgccaactggttaatccgctcttcaagaagcattaaatcgaatctatcccccaaggaactgctaagggacctaaccgtttctttcatttcctttaccgcttccctaaaatcatagggcagtataggaaaacaaaggagccgccacactactccaacataaacttttgtatcccttacaagaatgtccttatcaatgatatccatggtatcgtgccgggtatgccaccaccagccaagtccgccggcatgcttaggtgtgccggtacggaatgaaagtatatcccgtgtcttttcaatatcctgctcagaaaatgtcccaaatatggaggtaagccccacaccgtaaaatgattggtcagcgaaatgtcctatccgttttccaataaatgttactccggtctgtttttcgattacagatgctgcaagttttttcgtctgtggcattacaggcgcctcatcaataattactgcatccttacctccggtcgagtctacatacacatagcccacacagtgcttttctaattcctcgaaatgattatctgcataccatgcggaactgaaaaactttccctgtgaatgtccagcccaaaatgcaagtctgaggccccgtttccatgacctctgttctgaggcaagtaatcttgcacattcaatcattgtagcattagctgccccattatccatcgcaccataatcccaagaatctatatgacttccgaatagcagaaaatcatccgtatcttctgctttcatttctgcctcaagaagaggaacttttctccagcctgtatctaccacagtctgtatccatatctttacagtcccctttttcatttgctcccgtatggctgcgccatcctggcgtacgacagacactactggtatttgcggtaacagcttctctgttttctctgtggggcccccccaaagagatgataccggtgaattatgcaaatgattgtcctgtacataaatcactgcagcagcccccatttgctgcatatcccttacctggtcagcattaggcaggccatctatcatcacaatcaatccacgtatattaggacaatccgcctcaactgcaaaaccttccataccgttttccgccgttgactttgtaaagcaatgcgtcagtgatttaaaactcatctgtttaggtgacagcatttcaacatgtgactcaacaggaacgctgataaatgcatcatgatatgtaagtttagtattgtaaccaatttcctgcatcaccttttcacaatacaatagactgtctacttcctcctgtgttccggaaatacgaacccatttcgcaatgtcagaagtataccccatcaacttttcaccatctacgctatccacaaggctgtcttctatgatttccagctgctttaaatattctttcatgactaaccccctgatttaaaatgtttgctttgatatatgaacaactgtagaactgatagcagtaacagcattaaaaatggcacttgtgtcaaatgtcatgtcagacatatgcagccccggagtcaacccggctcctattcctaatactgtagtccttagccctggaattgcaacaggataattatggaaatcctcacctccgggtgttacaattgtagggcctaatgcatcttcccccaatgattttttaatagcatcttccgcgattgtaatcaattcatcacatctgcttgccgccggcacaccgccaagccattctgcttctgcttctgcgcctgcagactctgcactctttacagcagctctcattatattttctttttgcatctccatcagctcgtttgtctgcgccctgatatcaaacattatttcaacaaaattagggattacattaaacggattggctccactgctaatctttgttggttttatcgaatgcggtatagtgggattaaactgcagtgcattaactgcccctataatatttgcagcagccagaattgcgttcacaccttgctgcggccttgctccgtgggcttcatgaccgtaaacttttaccctgatatgtccagatgccccgtgcagaactgctggtgaaaccttacccatcggcagctcctcctgaggtcttaggtgtgtacttacaagatactccgtaccatctaatactcctgattcaatgactgcttctgctccctgcaaagtttcctcagctggctgaaacaaaaccttcaggcttcctgtctttagctgttgtgtttccataagggcctttgccgcccaaagaacagctgtgcagttagcatcatgaccgcaggaatgaatataaaccgcttttccatcaatctcatgttcaagcgcatccatatctgcccttattccaatagctgctccgctttttccggtatcccatatacctaacacagctgtttttgcaaaatctccttttacagtaaatccggctttcgctaactgtgtctttaaataatctgctgtatgtagctctctgaatgctggttcaggcatagaatgaagtgtattaaacgtgtccaatatcccggaatgatgtgtcttcacatattcataaacgtcacctatcatgttaatcacctccaaatgtttccgctcatactttttatgttacgttttatcatgtttctggtaaaaatttatatattcttttttatcagccgtttaatattcccccccaaaatgtccgcaatttcctccttagttatactcatggaagaaacagtatttacaggttcatcatctcccatatcaaaaggatagtcagttcccatgagaagatgggaggaggttactttcgattccacaaactgcagcgtctcagcatcatgtaaaatagtgtcatagtaaaagctcttgcagcattcaccatagcttctgtgtatctctctgaactccttcctaacctttcttgcatgctcaaatctggcaatcgcatatggcgtatatccccctgaatgagagaagcatatttttacgccaggatatttatttgttatatcccctgtcataagagcaaatgcagcaatagtggtatccaaaggatttcccatcaaattcctcaagtgatatctctctaacctggttgatttaattgtgtagtggggatgcagcaatacaaaaacctcattttggtctgccatctgccagaaaggtgccagatactcatcatccaactccatgccggcaatgttagttgctatttcaacgccagaacacaaggaatcattaattgcactatccagttcacgtatggcgccatccatatccttcatgggaagcgtggccagatatctaaacctgtccttatataaggccacatcttttgacaacgctttatttgattcatgtgcccaatccgtgcatcgcttgtcttcatagttcaatacgaacggaggaagtgagataaatctcatatctataccagctttatccatatcaataagctgttcatcaagattaatcaatcctctgttcaatggtcctagttctctttttttaataaatatttttttttcatttttgtcttcttccactttgaaaaaatcactaaacctatcaatttcggctaagcaagcagggatataatgagcatgtacatcaacaatcatttgcggtatctcctcccgtcttttataaaaagtatactactcaaaaagtacaaagtcaatatcaattgtatttatattgtacttattatgtttttaatatttttttttggctatatttaacaattcttattttctgtcactaatataccaaaataaagaggtactgcgctttaatctgcacagtacctcttatatggaaatcaacgtttattttattatcatcttcatatattcttccataaaaccataatatctgttattatgatgcttttccaatgccttggctgcccgcgtataatttctgtctttgatatattttagtattttaagatgatcctgcttcataagattcagccttttttcagtaaatgcaaccaaatgacgcgggtgggatagctcagcattcagagaattcaaaatatcaagtattcgagaatttgcacagtaacgaattataaacttattaaaatattcatctttagacttgatatcctgagcagaatccgctattgaaatagactccgtcactttaatacattcatcaatttcttcatcactggccttcatgatacatgattccagcgccttaacttcgagtataatcctaagttcattcatttccagaacatccttaaccgttaactgctccacaaatgtacccagattttgcaaactataaaccagcttttcatcctccagacgccgcaaagcagcgcgtaccggcgttcggctcattccgagacaatctgctatatcactttcgattatacgcttgcctgcctgcagtttatgctgaattatcaagtcatgcaggtaattgtatgccttatcctcgaggcttttatccttccttcccatatttttcaacctctccatcattattttcagttatgaacattaatccgattcatccgttatcgtcgcaattctgcaatacataacagactcttttgattcacattttttcatcataacatattcttaaaatcaattctacctttatatatctgcgcagggatgtttcatacatcattaaaacaatcttcgcaatgttcaatcattgtctaataaaacagcctgcactcatatctataatttagtccattttcttctttatgacaagtactctttcattatattttccccctcgccctcttctatcagaaccaagcaagcaataaccgccaaaactggacacaataatggcataaacccatgttgttttaaaaaagttactgatttattctttaactgaacggcttagaaccatagaactctatttcgagcttggtaacaatgctgcactgacagttcgtaggttgggataaccagatgttacatcgttagcgcactgggttgatgaatatcagaaaaaccaatcgctccatacgcaaaatatcgctgaaatggggccgtctgttgccagttccacccccatgttctgtcgtcctatcttatccacaaccccataactaccatatatagataatccccttccacacataaaacatcttgtatctacagtggatattgtggatatccatgtggataacacgtggattaaatgtggattccgtccggttccctcttcataatccatgcattcacacttcacttggccccagttcatttaccaccgcaaaccattgccccatgatttataatgtagtatgattaggatatagtatcagtagattggcttatcaaacaccaccggaggtatcaaaatgaaatttttcataaaagcgctcatcatcctgggggttatcatcatcttattcgcattaggcgacagcatattcaatggccttttcagcaatgacggctaccatcccgtaacccagcaaatgaaagagattatgacagaaaccaattaggttttttgattttctatttttatattcacaaatttcttacaaaccgttcatattttcgctatagcctgctcatatttggcccatatactatatattgtaagttgatattgctaatcagactttttttcataatacagccggcaggagaaatcctgaccggctcctccctttttacaggcctttatggccgtatgccgcatatcttgtcctgtttatgataattataagcgatttcttcaatacactgcattctactcatccctgcccatctgctttatgatttgattgacatacgtactgagccctgccagcaggattccctgggtgattgcagtaaatattgccataaaaatttcctgccctgactggcatgtgcttgtggcaaggacataaatcccgcaaatggcaatccccagccctccgttgattaaagggataaatctgtcctttaccgtctcactctgtttaatccacatgccggcaaaatacagcacaagggccaccacaatcaattccggtttgatataatctgttatctgcatatatgttcccctccttttacttgtcttaccattagtatattaatcagaacagaatttgacaggactttcaccgcaaaaaaagagaagccctacggctccccttccattttcccataaacatcactatctgccttttgtctcagtgtattaggccccaaaaacgctccgtcgtgccaacgtggattgaatgtctcgacattctttgcctgctcttccagttcttttgtggatttctgttctccctgcttcataatcatcacctctgggatagtatgtaccatggcagtctgaaacatgtattcatatatggaattgggtccaacacgggattgcgtacatgacattccgctctcgcagtagctgcatgagaacaaatagcactcaccccgcaaaaaatcagccccggcacgccattgcgccggagctgatttaaaaaggggaggataagtattaattaagaaaagccttatttatagcggtttatcatgcgccatggggtactgggaatcagtattttcgtggcacttcttgttgtctttggttatgtggatttaccgttatgtgggtacagagtgggtataaaaagtggcagtttcccggctcttaaaacgcctttgctatcagctccatttcctccgccttggttgtagggagtacgtgggaatataaatccatggtcattgatagattggcatgtcccaggatagtctttaacgtctgcggcttcatcccgttttctatagcccttgtggcgaatgtatgtcttaggcaatggggtgtgaaccgttcaaacattataccatctgcattaatacgtttcacaacatggtcaatcccgttctgtacccgtttctcactaataggcgagccatctggtagatgaaatatgtatccgtccatttttagcaccttttcaccataaagctgtttctgcctgtccagaatggtaatcatatctttggtaaggggtatatctctcttggatgtagccgttttaggtgtatcttcaaagaatccccggcctgtaacatacttgagtgttctttgtatgtgcagcaatccggccgccttgtccatgtccgaaagttttaatccccgcaactccccaccccttaaacccgtcctgattgccagcgcaaataagttatataaataactgtcctcggcatatttcatgaaagtatcctgttcttctttcgttagtaccctatgaccccctttaggcttggctttagaaagagttgcaagcggaacagggttgcgctctatcagcccattcttcattgcctgtttaaaacaaccgctaagggttgctgacacaagccggatagtagtatgagaaaaatcctttttaatcatatcattatatagcttttgaatgtgctcccctctaatctctgtcagcttctttgttcctaatgcatcttttatatagcggttgtaacaattattatagactacaaccgttcctgtcttaacctgatttaccttatactgctccatccaggttttaaaccactcctcaatcgtaatctttgaacttgccacaaactccccatgctccagcttataccacagttccgtcattctcttttttacttctgtaatggtatctccatagacagaatgactttggtaatccacctttacccggccctcatacttcccattggctcgctgccggattcccggcggcagaggcttcccattcttatccactgccatgcaatcacatcctttccatccaaggccagagcgctattcctgccccggccactccaggcactccatcatgaaagcaactccatacttaaacccgctgataaatccgaactcttggccgcaacagctcacctccagacagatttcctccagctcctcgaagtcctcccgccctttcaaaggttccattacttgtttcaattccttgcgtaatggctccagggccgccgccggttcagtcagttccccatagacgaatcggcatatctcctttaaaaaccttaccatgactaaccttcctctctgaatcacgtcatgcactcgaccatcattccaataccctgtttaaatccacatgtaaagccataccgttgtgcacacgctgccatatcataataaatactggccaattcttcaaaatcggtacgtctctttaatggactgaggatttcatttagttctgcattaaatgcctccagctccacactgggcggcagaatcccctcatttatctggtcatatatcttccctattgtattaaacatcataattttttcctccggttcaaattctcatttctaagattctgtgtgttttaatgtggggcgtcagtgtccaggagaagcgccctttaccttctagccctccggggatggtatgcctttacggtcacacactacgttcctttttctcctgtataacaaagtcacaaacagttccagccatatagaccataagtatctttactctaaacggaaaatcacttacatttatctcgtgaatccactgcttctttacccgcggtaatctgtccatgctgtaactttctaattcatttatgatttcatctataaaatctgcattgctatattgcatatctgcttaaattctccctttcccaggagaattacaaactgctgcatggcatcattctcctttactttttgattgcaaagggatgattctgtgatataatcagaatatccctgctgcattggtgtgtggtcgggtattgttttttcagccctgtgcatttgccgatgcatggggtttttaaataccctgattctgtgttgcatttttgttcgctcctgccttaggtggatatttctaccttgaaagcggttcacagcgttatcttacatctgtacacgttagttttcggcataaatcaaatgttagcaacgtccgttcagccgctttcctatgtccgctttctgttcctctgtaaggttcataactttatcctttgaccttacagtgatgaatctctttgggaacatatacctcttggcaactaccctgtcctggtatatctcccgccttccctccttgaattgttccgggttctgcgccaccagcttatcaagtttacgcatccaaaccgggtccgccgtgtaaagctctgcggtatcctctgccgcattgaatccaataataacctcctgctctgttcttgataggctatagtctgccatcctgcaatctcctttcctggtgtgtggccccggcagaggctctatgtaattgccgttactcccctctgccagatactttgctttctcagccctgtgcgtttacggtaaatctcatggcctgtgactggcccatgtacttctggtaaagctttggatggtcggcggcaaatgcctttgcattaaacttattgctgataaccaccttaaatctgaccatccagtcacctacctctgtttcctcctggcccctggcctgtagctcctttttgatgtcctcctgcagggcctccattttcttctcaatggctttcttttgggcctccagggccttaaggtcattaacctttttaagtaatgttctttctgacatagtgtgttctcctttccttctggtggattcttaccgggctattgttcgccatccgtggcgcatcctcaccggaattaaatccgcggcccctatcagtcttgcgtgtctattgcttgcggctcacagatacgattgataggtttgtgggggattgtctgccccggctgcttttgttttccttaaccttgtaactatattataatatatgtgtacgtatatatcaatggtaataatagccgaatgtgtacgtatatatttggtgtttttgtatgtgtacacattattgactttatgatatactatcattataaggtggagtaggtaactgtatttttcaagcccctattacctataattataaaaggtggtgaatatgtgtcattaacagaagcgcaaaagaaagcgaatattaaataccgtaaagaaaatcttaaacgaatcccccttgatgttcaaaaagagaagtatgaggaaattgcctctgctgcctctgctgctggtgaatctgttaacggttatataaagaaagcgattgaccagcgtcttgaatctgacaacatcccacaggaaggagaataacccatgccattaccaaaagaaagaatctataccattgacgatatttacagcctgccggatggagaacgggcagaactgatagacgggcagatttattatatggcaccgccgaacactacccaccaaagaatatctacctttctacacggaaccattttcaattatatcaacagcaaaaacggctcctgtgaagtattccatgcaccgtttgccgtgttccttcaggcagaggacgagaagaacaatactaattacctggagccggatatatccgtaatttgcgataaagacaaattggataataaaggctgccacggcgcaccggattggacgattgagattgtttccccttccagccgacaaatggactattacaaaaagctggctctttatcaaggggcgggggtacgggaatattggataatagacccggccagggaggttgttatagtgtatgacctggctaacgaaacaccacccaccatttatcgttttaccgattctgttaaagtcaacatatatgaggatttttccattgactttagccaattaagcatttaatactatccacattgcagcagaaccataacggggctgctgctttttcttaatccctctgcctacggccaatatacggacattccatcatattccaacatcagcgttccgaacgctcgctattatcgttccgaacgttcgcatggaaagccgtgcatccggcacacaccttttacacggtgttaccaatggagtacactataaggtaatggagtactaccgaatcaaaaccctagttttccctagcaatcgtgttgttttgtatgcattcgtttcgttttgaaaccttagcaaatcttagcattgttagcaaatgttagcgtttgttaaccttgacacttcttaacattcgttggttttgtttgttttggaagaatcgtattcgtggttttgtaatcttgtatatctcagtatttatgtttgttttgcaaaatcgcccttattgatataaaggttgggttttgtaaggtttttagtaataccatagcccggtatggcagtggaagggaactccaaaacctttttagggactccgaaatctcgggatacatgcgcgcgtaaccatgtcccgttatcccattttagggcctcacaaatcccagtatccttactatttcccgctgttccctcgccgttcacggattcaaacctctattcctgttgttcatttccttttaagcctctgcctgttgcgatttcacaacttcctgcctcaccctcgccaataactccagatgcatccggcgccgctcctcccagtccatcacatccagggccacccgctccatgctgctggtccaggtgcggttgaacttccccactccgttccccaccagggccatgccgtaaatcctgtcgtactccggtacgaatggccgcagccgtttggcatacctgggcttgcgcaattcccgcagggccttggcctgtatctggcgcaccgcctcccctgatgtaccgtattcccggcctatggcctccatggtcttattctcctggtagcgcttcctgataacctcgggctgctgccctgggagactgaccacacaatcccacaactctgctttaagatgttcctgctgcatccgctccagggcatccccttccacatcctcggcagaggccaccatttcccctatggtggtatcctccccgccgtcaataccctttacagggctgtccaggcttcccaggcgggctatgcaagcgttttcccttatatcctctatctgtcccagggtgaggcacataaaggccgctgcctccctgtctgatggttcccggccatattcctgctggtaagaactacggaaccgcttatactgctgcaccttctccaggcagtggacaggaagtcttaaacaactgccgttcatctgaagatatcggcgtatccgctgccggatgtggtattccgcataggtgaggaacttcacgccctgggccgggtcgtacccatcaatggcaggatacagggccagatagccttcctgctccaggtcctccaactccccgctgtcccggtacttccaggccacggcatggatgaagcgccgcacctgggtgtacagctgctccatgttcccggccacatccttcccggccttaatccttatcacaagctgttcattggtcaattcctcttgcttcgttcttgcttcatttaatgttttccctctgttcgccctttgttcgtttgacatttggcacacccctttatataatcaaattatcaagcgaacagaagtgtgcctctgcctggcctgtccatctgactatggatgggcctctttcattgccatatccacatctatgtataatatcctcatgggatgcttgccgtaaccgctaccattgaagatgttctccagttcgtccatttcaaaatcccccaggacttccgatataccgcagacagtaaagccttgctgccttagctccgcccgtatcccggtgactatctctatgtcatcctccagacattccggcggcgtgatggtctgcattggcttgtgaaagtggttcccgtggctatcacagtaatctaccatgaaatttctggccgtaatcggtatccctattgattgaaacaattttgttaataccatgtgcgccgcctccccttacaaacagaaattatcgccattgattaaccgattcatggctatacgcttctggcgttcctgctcctgttggcgctccgctttctgacgctctttttcctgcgcttttaattcgctggcttttttacgttcctgccgaactaataatttgggggccagcgctgccacaaactcttcttctgaactggttaataattccgctgcttcatcatcccttgtgtatactccgttaataatctcaatcttcattgctcattctcctttctttggtaatctcattacaggcggagatttaaggcggaaaaagcggaggatacattacagtgaaaatttcctgtatttatgggcctttgagccacctttttatccggcggagatttttgtagccgctcaaaatttttgtcaaaacttctcaaaacttttgacaaaacttttcgggaaatatttccggtatttataagcacgaaacggagggaaaaaccctccgctttttttgacaataattttgtgaataacgcctacttttcagaagcggcttcatcctcatcttcacacttggcaagttcctcttccaaggctccaatctcatcacggatgacctgtctctgtttgtggagttcctgaaggtcataaggtgactccatcccaagggtagaatactcaatacacttggcaatcttccagtccccaatatcagactcctgacatgagagcttggtcttcaggtctcttattttctgttctatctcatttttgctcattgttgttttgctcatctctgtgtcctcctccaataaatggatggataaaaagctcatcaaagagcttatccatactcttaactacattgtatgagtcatagtggctcacaccgcccttccatgaggcataggcacatctcacatcatcaaaggacatctccccggcatccatgagcttccggaacttcttcagctttctccgcatccttgtgacggagtccttgctgatacgttcctgtacctttcctgtctctgttaggttatatttgattttaaggaatgtgaagccatgtgacagctttactatctgtgttttctttggattgataaagagtccaagctcatcacatatcccttgtatgtcattcaggagccccttcaggtactccttgtcttcatggatgatgtagatgtcatccatgtaccgcccatagtatttcatgccttttacaatcttgcagtagttgtctatccttgtgggatagtatactccggatatttgagatatttggcttccaatacccacggactttctcatgtacttttcgcctgtcagctttgccttatcaatttgagcatgttccaaggcgttatacagcgttttcatacagttagcatattcttcatcagtcatgtaggaaacatccaccctgaaggtatctatgagcttctcaataaagctcatcgtctccttatcaccaatctttttccgcatttcctttatcagaccatcatggactatattgtcaaagaatttgctaaaatcaatcagtaatacatacccttcattgctcttgtgtttcctgtagaacttgtgaagatgtgtgctcaaccgtttccttgcaaaatggatacccttgccctccatggaagcaccattgtcataggtcaggtacttggagagctccgggacaagcacattgtcacagactgacctctgtaccacacggtcagagatgtgcattgacttaatatgccttgtttttcccctctcatgcagcttgaactcatagaagtccttctgctcataggttccatccttcatctccttttgagtttggttgatattcctcaaaaggttcatttcataccgctgtactgactctttccacgctgttcccttctttgacttgttaaaggcatcaagtagggagttggcatcatatacagactccatatcattcatagagcttcacctcgtttctagcaccaactgacgtatcagggtgcatcaagatgttcccccatcctccctctatcagaagatgagcttctttacctttcggaaggacaagctttcctttcctgtatcgtatatcggcacatagcctacacttagtatacatacacgaaatcgggcggactccaccatccccggcggcgttgttattattactattaccattattgttacaattagcaaacgccgccgccgacaccacagcactcaacggtggaaaagtctctggatacaaagcttgccccggataattatacttgtttttcagccttttgggaagcaccttctttctgtgctttggctgcttcattctccctgattttcttcaggattttgttgtcactctttctccatcccttcaggagggctatctccttctcaatcatttccacatatcggatatacttctgtgcatccaccgggatgatggatataatgtattgcatctcctgaaggagctgctcacagtttcctatggcatgattttggaagtttctccggtcatagaactcactctcacatactggatatatcgtatttgcctgtgtgatgttcattatcatgttgtggaggatattcattatgttattcctcatcttgtctatgagccatgccggatattcctctattatcgtggctttcatttcatacttctccactatttcccgaaacttctgctcatcctccggctccattcccggcaccccatacaatgacttgacactcctcaccttgtccttgatgccaaagtcccggaggagcagcattgtgatttctctccggagcattatggcattatgatagaactccaaactggatacacttcttttgttcttcagaacgctcaacctatttcctccttccggtcatctgcccccatacagggggcagattaaagattaaccgatacagaaatacgggcggactccaccatccccggcggcgtagtcattattactataaccaccagtgacacaaccagcaaacgccgccgccgacaccacagcactcaaccaataccaccatctacttccgttatgtccaagtcctgctaccttcaggttaggagctaaccggaacaacgggaactgaatattatcacatcctgtatcatagaatgatgaactaagcactgtggaaccatatacctgtatctcactcataagtttaactaagcaatccttccactcccagttgcttgcatatcctgtgatgcctgctcctgcgtttgaattgcctgttgtagatactgctgttgtcagcaattctctgtgactaagtatatgattatttaatgctgtttgcaaggctgctgcatatacaggaagaaccgttttatacatcttagagcctacatacccacctgttgtcacatttgtatcattcataactgattttgtcttgaagcagtccttcggtacaatcacagcatgatgttttgtgaaggctgtatctccattattccaaaatacatcaaagcctgccaagatacatctgactgtctcggcaccacccaagtctgtagtgatgcttatgtcaaaataatcacccacatacaagtccttaaaggttcctgcactgatacgctgacatatttcatccaccgtatacacatttgtcagattcttccctctgtagatggaattatgagctgctgcactgtcagaaaagacattgatgaactgctcattgaggtatttgtcattgtcaaggagctgctgatgtctcacattccactcatcatagtgtgccggagttgtcctctccattgctgtcatctcaaggacaagtttcggatgctctgctgctgttatatttgccattttcttcttcctccttaatagttgtcttcaatggtgaatgtcacctctgtctcatccttaccttttgcaaggaaattagagaacgccaccacatctccatcctcatcaatgagtgccatctcactgatgaatgtaccaacaagctcatcttcctcaagcttgatggtgtactcataggatgtatctgaagtcttggttgatgaagtataaggctttctgaccacctctttcttcaatgctacattctccgcaagtggtactatcacggtaccatccgcattgacaccgccggaaccaagtgcaatgtgtgttatctttgcaaccgttccggttgtatggcttgcttcagccatcttttttcttctgattttggttatcacgctttttgttgccattctacaatacctccgttttttgccaagcatctattatcttggaaccatcaaggctccatgttccatcaaggaagatgaggttgtgctcttcatgccatatcaccctgaactcccttgtatgttctacaccaaagctgtatgcctgcttggtggtgtattctgtcctctgtgcatccatgagccgggagcctgtcagcttccaaagcccgttgagcttcagataatcaaagtagtcaatgaccatccggtaccgctccaatgtcttcctgatgctgtattcctcctcacaaggctgcatcctgtaccgctgcttcaggagcagctcctcttcatgctgatggtggaatgttgtgctccatctcatttctcttggagacatctctgcatccaccacatggcttccatctgttatccatgagccatctgtcttcaggtattcaaaatagtacatcctgaagctgtatgccgccttcaggatggcactctctaccatccggcaggcataattgtatgccataactgcaagcccggcttcatggagctcataaaggctctcatatcggtatcctatccgggtaccaacgggagtcatctctgcatcaagcatatagctcccatccagtttccacattccatcaagcttcctgtagtcataatagaacagatgcttcttatacagtacctcaaggaagtttcctgtgtgtggctgcctgatgctcaagttatacttgaagaagtagttgtcctttgcacccacctctttccacttcctgacggtcttccgcataatgtcaaaactgataggatgctcctcatccgcatccatcacaattactatgtagaactccgcccatctgttttcaatggtatcagactccaatgtccggctcccatcaaggagccaacttccatcaagtgtgaaatgggaaaagcctgtcaggtcatttgctctcacaagaaccggggaagtatatccaagagtcctcaccgcaagcagcactccctcattggtacctccaagcttgcatatctcctcatacatggctatccttgagcggaagttctctggatgttctccttcataccgggtgagccttctatcagctccatgtaccgggagcatttcatggctgcatgtagcaaccattccctcatcccttgcccggagtatgtcttcctttgcttcatcaaacctcttgccgaacacccggcaaaggatgtaccacttattcagtgctttcttcagcttcttcagaggagtagtgagcagataccacatgtattcaataaagttctctatcatggcggcatcactccttcccccttgcactctgtactacgttccggacagtcacattgatgtctcctgccatgatgaccttgtcctgttcaagaaccatgtcatcagacggttgcaagatgtctgtcttcctgtagttatcaatctttgtactaagcacttggatgatgctgtccctgtatagggtattcatttctccccttgtcagagccatcatgtcctcaatgagttttgttgcctgtgcatccactccatccgttgccgcatcttcagcaaggtatatcacaagctcaaagtcctgtctcactacttcactggacttcacaagatagtcctcatagtttcccttcagcggctcaatggcttcacccacctttcttatcagctccggagaagcttcccctgctgcacctgtgacaatcacatccactgtgccctgacctcttggatgctgtgcatcaatccgggcatccagtacaccgggtacagcctttgcagcgttccggagcttctcttctatagttcgtgttgcaagctccgcccatgagctcatacatctgtcacggaggtcttcaaggtcttcctcttcagctccttcctcaaagagccagtcatcctcatttgtcacatagtccacaccatcaaggtgtatcatggatatggttattcttcccggtgctatattgtaataggttccggtagcttcagcctccacaagcactcttcctacaggttccccggcatcaatgaccgtattctcacagcaatagaacttcagctcattgcctccggcatccggttctgttttgaaacaatgtccttttgttacctgaagagcattgttgtattcactcctgtatatgctcacataacctcttgctgcctttgtctccttctgctgtttggaatagtcggcagccttaatcttcagccagtctccttcagcatgtttgatgaagcatccattcacgatagtacgggcaagctctttcagctctatgtatatggtcacaagcatccggcaaaggtgatagaagatgccgccctttttgaagttcgttataggaaagccttcaccctcaagctctccctgtaccttttccatctcctcatcttcatccgggagagggataatcttctccataatgctctcatctatcattccacaatcacctccacgccattgctctcaatgtcaatgttatattcactattgctgtctgtcctccggaaggctatcctgatatggtatatatgaccgtcaaagttcaccgttgtctgtatgcttccggcatcaatatagtcccttttggacatcttggaacggatacgctgctgtatttccatctgtgtgaagtcatcatactctccctgcataaagtcaagcaggctccacccatagcttgcatccccttcctcatcctcatagaagagctcaccctcttctgtcattgcctcattcttaatatcctgaagccaacattcatcatccgatacaagggctgtgtccccgttcccgtctgatacaggctgaccatcttcatcaagcatgatgtctacatcatttgcacctgttatctgcatcagaagcacctccctatgatataaggcttgcactcaccatacatgagcacgattgccacaatctcattcttcaggacaggtatgtcagttttcaccttcggtacctccgggaagcggatgtcaggctgcttgtttttgtcaagtattttgagagttgcttcatacagctctccgttctgtctcacagataccacctttgcatataagccgggcggatactgcatgtgtggatagttctcttttatctgattttgaagctcctgctccacaaacatcttcatcatgtcagacatccttctcacctcctgcaaaatagatatacatgtgtaccgctccggtatcatcacttctcactattgtcttctctactgttacaattccgctgtatttgctgtgctgcacctcaacttcttggctgtggtgtatccaagggatggctattgtctccgcctcccaaaggtctccgtacttattcagggacaggatggtctctccctcctcaagtacatatatctctttctgttcttccttggttccccaatagaatacctttttctgaaagaagaacgggttcttgatgccccatgagctgttgacctctgctatggtattgataccgctctttctgtcaatgacaaaaaggtctttcttcccataatgttcatcagacagcacatagtcctcaatccctgcacatgccaatacataccggatgacatcctgcggctcacagtctacaaaggatgccttgatggtcactctgtcaagcttcatcatgtcatcttttatcattatttccttccagtagtccgtgtcaccgcatctgacatatccatcaatcaggctgtcaaagtcatcctcatatccaagctcaacgcttgcttcatccatatctttgaacttcaggactccctgaagctgtggtgataattccacccggcaccagtccatgtgagactctttgcttgagaaacactcaacctctataccatccgtcacctcatagtctcctactgtcacccggaactccggggatattagcttcttgtatcccaagcttctcacctcctgctatttcacagccgcccttgctgccttcttacctctgcttgtgttccggctgtcctttgccgggcttttgctttttgatttcttactctttgacttctttgtgctctttttagtagtctttttctttgtggtcttctttttcacctttatcccggctatatcaggagcccacagttccaatgaagctatccgtttgctctctgatataaccttcttagaggtgaggttcttgaagtatacctttgtgataccacggactgcacagtcttcattgactattggaagaagcttcggcttgtcctgaccataaggcttgaaaagccgctgcatctccgtgagctgttccaatgtggtagcagtctttgtgtcctcaagcagtatgtctatcatcaccttggcattttcatagcctacaggctgtgacttcttgtatctgcccttctcatcctgtgccacatacacgcttccggcttcctgaacctccacgcttgtgacctgaccttcaagatatatacctccaagcttcactaccttttcctgcacatacagcataccgcctcacctcctatgttgttgccggagtagggctgtctgtccggttctgtgcatccttcagctcatctatcagcttgtagagcagaggcaagtccttaatcttgcttatatctacagtgaagctaatctgatggatggtggtgccgccttctttgccccatctctctgatgtgtatgtctcttttgtggttgttgtcttgctttccttttcctttcgtactgatgcagcctttgaggtcaaagcacttgtgatgtttgccccggtctgctgtactgtatcaccgctttcttcgttctctcctttgactacgcctttgacaatctctgtcatctgcttccacagtttggataatggaagcaccgcttcagctccggcttctcctcctcccaagaggttccctcccattgctccaaagatggttgctccgttcaggataccgccttccttgtaccattggatggagaaggatggcaatgaaccttttccgccgataccataaggtgcctgtccaccatttacactaatatgtggcagcttcaagtccggaagcttccatgagaaattgaaaactcctttgattttctcaatcgtactggacactacagaccttgccgcttcaagttttgatgagaaggctgacttgatactgtcaagaactgaagagaccgtatcctttgccgcctgtatcttattgcttatagtagagcgtatactctcaagcttcccacctgtcagattgtttatcacggagtatgctgtactgaaggtaccctgtactcctgtcattgttgctgctacaattccctttatgcctccgccgcttgactgatatgcagcctgcatattggagagctgtgtgcttgcatagttcttagctgctaacattccggatgatactgcatttgccacaccggacatcttctcactgaattggttcttgatgtttgtgagctttccgcccgtcaggttgtcaatgaatgtgaagcctgctgtgtagtatcccttcacgccttctacagccgccgctgctacgcccttgatgccgccgccatgttcttcataggctgccttcatattgccaagcttttccttcacggtgtcggatgcagctcctaagatatttccaaagaagcccttcaccgcttcaagcccgtttttgatggtgtccttcatcttcgttatggtctcggttgcatctatgccgattgccgacaatgcaccaccaaccacatccaaaaatccggatgcaaacccaccaaggaatgagaggatggcatcaaagcagttgaaaaagaagtccttcaggtctccgactgctgcggatgcaaagccaagagctcccgaaaaatcgcccttgaatagtgagacaatcatgttcaccacattggtaacaaagctcaccaaacttgagagggcattggtcaacggggtcagtgcggatataattccctgaatacaaccaacgaaatgaccaagtgctaccgtcaggactgcacctaagacagcacctagtacctcaaggattggctgcaccgcctgatacagttccatgaacttctgacctagattttgtagggcaggcttcaatgtctgccatgcctgcatgaaggatgatttcacctgttcaaatagtccaatccaaaagccacggaaggcttctgacttattccataggactacaaaggcggctactagagccactattccggctatcacccacgttataggggaagcaaggaaggctgtattcattcccaaggttgcggtcttcacaagtcctatagcgttctttgctgacaggaaaagctttccaaggcttcctatcacacccatcacgcttcctgctatcacaaggaacactccaagcttcagggctatgttcataatgctctgaaccgtttcctgattgttgcttatccacttggaacccttctgtatcagtccgctcactttgtccatggtattgttgactgccggaagtagtccatttccaagttcctccacattgttgtgtatctgttgcttcagcacttggaacttctgctccggtgtgttgttgatggcttccgccatctcctccgtcacagatattccgtttttcatgcttccctgcaagtcctgtattccactgtcaagggtctcaacattgttgtataaaaggtctataagggcaaccgcctcatccgttccaaaggcttccttcagttccctcttctctactgcatcaatggtctccccatatttactcttcagctctgtcaggatgtccggcattgatagtagctgattgttggtatcaaggaaggtcagtcccaacttctctccggcactggatgcctgattgaggaaggacttatactttgttgctgcttcagaaccggacattgtagtctgaagctgtcccattatggcaagctgttcttcaagtgggacattggcatttgtagctgtggctcctagtgctgatatcgcacttgccatctcggagccggatgtcttgtagttcttaactgctgttgcaattccggcggagaacatctcaccaaactcaaggtcagacatatcatcataaaaacctttatagataccgtaacctgtggcaaatagtgagcccatctcttccgttgttgattttgtggctttacccgtcagggctgccagttgtgtgaactgtgccacgccttcatccgtcaaggatgctatacctgatttaatatcataggatgccgttatgaagtccgctttgcttgttcctgcccatgtgttggagaagctctttgccgcatcctccaccgccttcaggtctttcactcccaaagaggaaagctctccaagtgcgttctgtgtatcaaaggtggctgtgactgttttcatggcaagcccggtgatggttccacctattcctgccattgctacccctgccttctgcatggttccaaaggcagaattgagcttgtctacactaccggatacgctgctctgcacactgttcatctgaccggaaagattatccaccaagttcaggatgacagacaatttgtatactgactccatacccatgcaaccacctccctgttgctttttacttaaaatgtgatatactattccttacaagaccatagaggtgtatcaagtcccacagtttccggctgtggggcttttttattcgtcattactaaaattgtctgctattccttttgctacgcctgtctcaatatcttcaattctcatctctcttgcacagtccgcttgaccatacagctcaaagaactcctcaaaggtcaggtcttcaaagctttctggaagcagttccttgggaagataggtatatatgaccatcttcccatagctcacaaagctgctcttgaaccgctccttggcatcctctacagcttttttactgatgtagtgtctgccagtccaagcatacggagaagcttatctgcaaggctgatagtgattgccggatactcttccactgtttccttgagcatgtctctctgctcatcaatgatgttgtcaaaagcaaagctcttagatgcctttgtcacagagttggacatggtcttcacatatctgtcataggatgctgccttcggcttcttgaagaggaatgtgaactcatcctctgtctcatcatccacctgtaccgttgttactaccgtgtagaccttctcatctgaagctgcatatttcttcttcaggctctccacatctgtcctcttctctgcatcagcagcctttcctgcattgaggagctgctcttctcttgtatcattcatggtttatacctccgtttttgtcatttattttgttattagttacgcatcaagaccattgattttgatgccgcccatggcgataccatcaaggtctaccttcatggacttatctccctgtgccgccttgaagctacgcttcgacagcacaatgttggtcagtacatccgtacaggttgcagctccttcgtctgcatagttcactacaatcttcgggataacatacttgtagaagttcttatatcccttggactggatgaccctgcacatctcattgaagtcctcacggagcaaggaaagcttgacggagtttttctgatttccggtaccataacctctaatctttccgcccctgccatagataggctcactctcctgctcatcgtcataggagatttccatgggttccatgttttccatgccggaagctgtgattgtcacgcttgaccagtcatagacttttccgttgattaactgcttatttgccatctgtatctacctccttcctaagatgctgcataagggttctctactgcaaaggtgaggttcatctccctcacatgtcccataggtacataagtgatattgatgtcaagcttctcatccacaaggatgttgaggttctccgtgtcaatggtcacgcttccggagctgatgactttatcacggactgcatcttccacaggtgtattgagctgctcctgaatgtttgtgatgcttgtctcaatatctccggggtcaacctccacctgaagctcatcaagtgcctttgccctgacagccttgacaagtctgttcgacaccctgacatcttcagcataggagtagtcactaccttcaggtgacatcatatttgcagaggtcacatagtagtcttccttgccaatgtactgcctgatggtcacatactttgccttgtccaaggtctcaatatagtcctcaattccttcaggaaggagcttgagaagctttgcttcagagatagggaagctcttcacctctccaatgctctgtgactctttggctcttccatagagtccggtcacaattcctgcattgttgatgtcctgaacccttccatccattctctgataacgggaattgctacatacaacctgcatgtagatattgttgatgcccttccgttcctcaagcattgcgttcacataatcctcaaggctctcatctgccttctttcctcttgcctcacagacaaagaacagaggtctcttgtacttagtcaggaagtcattggcaatcgtacacagagaagcccacaaagccttggatgatactccaacgatatgaacaaactcaaacataagagggctgttgatgaggctctcaaccgcactgattactgactcattgctcatagccggtgatgtggtggagaatgtgaaacggtctccctccataaagctgtcaccgccttctgcatccgtgaactttgcagtcagtccggtagttgccagttctgcctctccggtgataggtattgtcatttcctctgtgaaggtatttcctccatccaatgagtatctgaagcttccctcattgcactctccggcatccattacctcaaccacaatgtcataggcattgttagggcttccctttacctcaaaggtaccgtatcccttttggtcttccgtgatttttccaatggttccggctgtccctgctttcaccgggatgcaatagattgaggatgctccccactcaaccgcatcaatgcaggcatcagcaagaggtgtgttgccaaccttctccttgattttcttggcgttcattgtgccactaatcaggataggtgacttgctttccacattggaaatgccgattttgattgatgtcccggtacccgtggagctgcttctcccaaggttcccgtcttcgacttttacatttacatctccaaacattatccctttgcctccttgtctttcttactcccgtcaaccggggctttccggaaggcttcacaggcttctttgaactctttctcttccacctgtcttccactcttccatccgtttgctgccttcgttccttcaaacaccgcatcagatacaccaagtttctgcttgagttcctcaatgctcattaaggatgcagcctgttttgtttctgccatgattattcctccttatccgacagagccaatgtccattggcttaatgtctctatcttgatagataccgccttcaaaagtgatgtcgaactgtaccgctactttcgccttcaggatactgtcaccctcttctacccagtccgcttcacctaccacgatattcacccagttaccatccacatcaattcccttcttcaggtttcggagaaagttctcaaggatttcctccaccttctcctctgatgtgtccgctatcactatatggagtgatgtgctcctgtcccacagcttcactctacgcttccgctgcccctcttggtctatgtatgttttttttgagccggagcgtgcgaatgtctcaccgtttcgcaatactgcaccaacgtggacttcgtttcctgccttcagctttttcatattggtgtagacctgactcttgatgccggagctcttcagcgtttctattaagtagttcctttcctttaccatgtcctactcctcaaaaatttcctccaaggtgtccttgatgtcctgctcatcctcttcactgatacccaagaacggtcttggtggtatgcttactttgacagaggctactctcttccattgtccaccaatcttgaatgtgaggtactttttattctttgctcttattgtccgctcatcaccaaattggtgtgtggcagccctgatgtcattggtacctactgcaagtccactgtcactcacttctgaccggatgcttgttttgagctgtgtggtcttggtgagcgtcttgccgccttcctcctgtgcccggatggatggcttccaacttgtaccttccggagtcttctcctccgtgaagcgttccactgtggaagtcctcaatccttccgctatggagttcagaaccccacgggtctcaaggtggctcaatcggttcaggcgttggagcagctcatcagtatctccggacatctctgccctgattgacgacatcccatcaccatcctctcatactgtcccttgagaacaccctgcctgaagacttcatcttgaagccattggctgcttcgctgcttcctcctttttcctcaacgcctatgcttatgatgccctttgccacatcaagcagaaacttgatggctgcgttgtatcggttcaggaaggtcttctcccggtcactctcatctatacctgtccttgatacaaggttgtatacagatatgtcttttgcaaatttgttgatgacctgtggtgtcttagtgaagggaactctgtaccgtttggcaaggtacccgtcaatctcggcacaagcatcagatatagcagactcacatagtgttgcaatcttagcttcacgctcctgctcatcttctatgtactcatctccaatgatgacattcttcatatcatcctttatcatttcaagaacctctccaacagtacagtacattccaatcacctacttcttatccctgtgcctgtgcttctacttctccggtagagccatacgccatctgccaaaaaccatatcctgcattgcttcttccatcagctccatacaggtactcatccaacatgaagacattctcatcagtgtctcttgttaaggatgtgaacttgattttctttctaagctgatagatgaaaggcttcaggaagcggttggtgcaaagaaggaaccaatactccggatgctctgcaagggcaggctctacatgaagctttgctgttcccttcagcacgtttgtggtaccgtcaatctggtctgcttccaagatgagccttgctgtctcctccaatgccggaggtacaaccaaaaggtcaggcacaagcttcaggctcttgcccttatctcccttgatgctcataatggagcttcttccttccatgtaggactcccttgacagcttcttattgcttctgttgctgtaggtcgcatcacctaccttgtgggctgtattaaagaatgaaagcccgtcatagcacttctcattgaagccgctcatcatagcaccaaagacaagctcatccggctgcaatgcagcagcttctcccatgttggagaagagaggagtatacactccatacttgtcatcctcaatgtcatctctcggtacaccaatggtcatctcaaactttttgttcttgatgaggtagtcataagcagcaagagcctgtacttctctctcaccaatccactctctcatgcccggcatctgaccaagccacttgtaatcctgctctcctgtggtgctcggtaccacagttgcaaccttctgataattggactgtgtggtatcaaagctcttgttgaaagctgttgagtatcccactgtaagtccgtgtaaatttgcctgattaacaatcatgtttcatgtcctccttatacctgtgttatgtctacggtaacgccatcatcatctacctctaagatggtgcctgctacacttgagccatccgctgtgatggtcactgtcttctcatccttgatgtagcacttcttcaggatgtcagtctctttgatggttccatcattctcccatacgaatgtcccacgcttcacactgacagtctgctcaccatctgccccgttacggttgtcacaatatctctgcacacatccggcaatcaggagcccggcggaagcagttgcctctactgcataaccatctgaattgatggctgccattgttgcctctgtcagttctgctcctcccttgacagggatgttgagcatccggttcccggttctctcgtttcctgctctgttcatctcttagtcctccttcttgttgtacttcttaacatcctccatggatactcccatgttcttgaggatggctacatccacctcatcagagttggaagctgccggagcatccttcaggtcaagcttgccctgcggaactactacaggagccttgtccacaaagcccttgaagccttccatatccttcagggcgtatgacttagcccattcagactgtgcggctgtgatttttcctgccttcaatgccttctgaacctcctcatctgcatctctttcagccatacgctgcttgagtgcaaggagttcagcctgtgtatccggtgctcctgccttcagagccatgatggaagctgccacatcctcggtcttggcatccgccttcagtccaagcatggaaaggatggtgctgtttgccaccatgtcagccccttcaggcttcggttcaccatctcccggcttcccatctccttcacccggcttctttccatccatttctttgagcttctctgctgcttttgcagcatcctcaaccgctttcttgatttcctcttccgttgcggtctccggaagtcctaatgcctttgcaagttcctttaagtccatgatatttcctccttctgaaatgtcctctatatcaagggagttcactaatgcaaacatcccatcaatagcaggtgtgtttgtaagtgcaacagagtgtattgctgttgccttttggtctctttttcgcaccaataccaccggggagaggtatctgtactccttattcttcaggtactcggctgcttttggtgtccattccacctttgcaatgatggcatcttcacctttgtagaggtcttttatccatccgcctgccggagcctgcacatctgacagtgtttggtgctcataatcaatgacaaggtcaagctttctgtccttgaactgtttccggatgagctcaaagctctcatcatccacattgaagtcccccttttgggaatgtactcttccaaggggaagtattttgatttctgtaggcacaccggagagctccacgccctgtccggcacatgcaatcagctttgccatatccgctcacctctttcctttgctttctgatagcgttataacgcgttataacgccccttagagcttctcaatgtaaatatccttagatttacctatccgaacactcacagcctcttaaaaaggctctcattttgtttcaccatcttccggctgttttctctccctaaacatcttcctaagctccggagatatattggtcatgtccggcttccatacggtctttgccgggttattggagaagcccttgtcaggaaactttgtgagtatctctccggtggagtagtccacatcatacggtgcctctgtttcaacatgcaatcccatcctttcaacctgtttttttgacaagctcaccaccatgcagcggcaccggaacccgttgggtgggtaccatacatcccatatagggtcatctgcccggtacactcttccttccatgactgcatgtgactctctcacatgtccgtctccggctgtccggtatctccaatatggtcttagcttcattgtggtctcatttgtcatgctcttatagtgtcctgcattgagggcggtctgcatgttagtcctgaagatgttgtcacacttccaaggattgatgccctcatatccatgctcctcaaggaacctgttcatatcttccaggaactgctccttggtggttccttcttctgctgcttttgtcaggcagtcaagaaactcctgaaggacttcaagacttgtatatcctgacaccgtgaaagcctttgcccggctctcatcagacagcatcttatactcttcacttgtcagtgttctcttccccttcaggaacgccaccgcctccttgaagacaaagtcctttgtcagtccatacaatacatccattagtccattgacctccctatcaggtgtgacagatagatgccctgctgtatcaggtcttcaagctccgggctctccatatcctgatacaactcacggagcttcttttcatccttcagaaccttttgcagctcatccatgtcctccgctttgtcaatcattttgaaaataggcttcatcatctcccggaagatgtcctctgattgcttattagcaatggagacgattgtgtccacctgtctctgttctgcctgtccctcttcctgcttcagcttcagctcctccgttgtttccattggttgctgctgtgctgtcatcattcctgcctgcggcggcttcaggacttcctcaccgttttccggcttcggtatgttgaatttcttgtatatgtggctctttggtatctcaagccccatatcacaggcaagtgtcttgtatatttcaactacttccttctggtcttccacctcatggcagtcaaagccaaagaatggtatgtttgcttcacttccatagttaaactctacaagcggtctgataatgtcccggcggattgtcacagctaatgactttgcatcagctacagtcaggtcatgcctgacctcgttatgggtctttgactgtgcataagagcctccgccgctgtctgatgtgagtgtctgtccaaggattgccttgcttatctgctcatcacaataccgggcaagcttctcatatatctctacgcttgtggtcttctgtgactcaatgaactctatcattgtggagctcggcacaatcccggctgcatccgttccaagactgatgatggcttccatgagctgcttcttgtcactctctgatgcagaagcatcatacttaccaagacggagcggcataccgaacacttcacagaagctcacccaatccttgatgtcatagttcttgaacaggtacatccatgagacaaccctcataattcctgcccggcttgcgtgtcctgactttgccttgtacttatgtactacgaacttattctccggaagctccacaccggaaggatactctcttgtgcataccttcagctcatccgtggtactatcccacacaagctttttaggatgcacatactcaatatcctcaatgacattccttccatcctctactgtccatgcaagctccatgatgctgataccctttccaatggcatccaacatatcaatgagcacttcatcaaagttctcaattcccttgagctgctcatctatgaagtccgctatctccttgtcaatctcatcttcagagaatggctgcacttcccaatcaagacccgtcacagcaagctttcttgtctgcatctgtgagaagaggtgtgtatccttttcctccatctcctcaaagagctccatctgtgccctgacattcccttcatcagcttcccgaaagatacgggcaagcctgcgtggtgtcagtccgttggatggataatcagagaacttgtcattgacatccccaaccgccactcttgcggtcacgggtctttttgttcctgtatctacatccggattgaagggtactcctccgccccggttccttttctttctttttgccatgctgtatcacacctcctagtaggcacctttacccatccggaaacgtctccggaggactgtcttgtaatttgcttttgatgctaccgccttgactgtctgtgcaagctgcaccgccatctgaagaccatcaggagcatcatcattctttcccatagggaactcctgaagctgtttcaggagtgtcttgtgctcccggttgaatttcaggtacttgttcttgatgacaggctgcaatgactcaatacggagtaccttgttgaccgttgactgtatctcctctatcgggatatactctccttcctcggctgactttgcagccatgacctccttgaaaaagtattggaactggacaacttccacaccaaacttgtagaagcccttcttgcagtccctcttcagtctccggttcatctcaaacacatcctcaatgatgacatccggcttccttttctctacggaggcatccaccacatacatgtacccggtcttggtagacagggcaaggttgatgatggagcttgtatctgacttcttattctttccaagtgacgggtcatttgcacctacaaagacgaactccggacttgagaagtccatgagctccggttcataataatcgaaccattcaggattgaatgttgcactctccgggtcaatcgggtcattctgaagctctgaattgaaggatgctgtaccttcggataccttaatctccatcaggtcatagtaggacagcttctcttcccaaaggacttcagctccaaggagcatctcttcctcatgggcttcatagaaagtccttgcatcctcctcatggttctcattgaagaggttggtgtagatgctttcccactcatcccacagctttgtattgactgcctctgatatgacagccctgtacttcttggtcttatatcttgggttctgaagcacattgttgagcagggagtcatagtggagtatggtacctatatacatgatgtctgtgtaggtatcccctgcttttgatactgctttgtcaaaccaattcttcagcttacgcctctgctccggtgtgttgacattctcatcattctcaatatcatccagtacaatgaggtcaggtctccagttccggtgtcttctacctctgaccttctttccggagcctattgcctccgccttgatgtctgtcttggtcagtatcactccggttctccatgccttgtctcccttcagggagccaaagtccatgataatgtttgcattgtcctcaagctctgtcttgatgtcatcaagaaagccttccgcctgttctgaagagtctgacaggatgagaatgtagtgcttgtatgcgtacaggatggcatggagactgtctttgaatgtgaagttggttgattttgcatgaccacggggagctgccaccacctgacgggagcccttcagtcttgatatgacctttgcttccttcagagggttccttcctttcattactccccggctccatatctcatcaagctcctcatggaagtgtggtgacttccggatgaagtagtgtggaagatacgcccttccaaaatatgacatgtcaaaggcagcaagttcttttctaagtccatgctctcccatgagctcctccccggacagatacctctcattcagttttcttctttcctcctgatggtctgacccacggagtacatattcctcaaagagcttggtctgatactcctcattgttcttgatttctatatcttcctcttcctcaagctccctcatccagttgtcaatatcaatcatcttccatcatccgctcctttgcttttgccagtatctccttgagctgtgctgctgacttctcatcctgcttgatgaccttcagcatctcggactccatttcacggaaagcaatgtcagccttccttctcatgtcctgcttcaccctgtccttatatacctttgtccgggacagtgaagcaatgagccttcctgccttatcaagtggcatctcattgaactcttcctctgcggttgccaccttgttcaggagcccgttcatggtcaagagtatggcagcttccgtgtagtccgcttccgggttctccttcaccacctgtatcagcctgtcagtctgtgcctgtgcttcaagaagcctctgcatggcgttatttgtccgggtggcatatctgcctacactggactttgatatgtcatagccctctcccttcaggaattggctaatatattcataggtattggatgtgtcagcaagcatcacatccactttcatccgcaagtcttcagggagctcatcaatctttgaggttattctctgcttggttctcttatcacccatcaaatatcaaccccattgtcttcaatcgtaccttccgcaaggtctacgccttccttggtgagcttgatgactgcatcattggcataggcattgtaggctgtgaccttttcctcggtaaattcgatgtatccggctccctgaagataatcaagatacttgctgatgtccggggatatgatgagcccggctgctatcatggcattggataactgccttgtgagggctgtgttgttgtatcccttcaccaagcaccggatgatgtatcccctgattgccttgttctgcttgatttctgctttttctaagtcattcacgttgttcacctcactcttttctgttactctgcattaggagcttgtcaatcttgctgtcaatgctcctcattctgtcctccactccgttcatggagcggaagaagtcttcacggagtacaaacgtggtagcaaaatcaccctttatatcattgagttcctgtttgatgttcgctatatcccggtctgtctcctcttccaacttgtcaattctcttatttactttgtcatcattctctttaatctgcttttttatctcctctgtgctgctcttgaggttgttgaaccaccccttgatgaagaaggttatcactccaagcccaagagtgataacccctgccatcacatcagagaacgtgataacataatccataggctacttctttctgatgagcttttctgcaagctctgtgaccctttcccatccatccattgacaccaacgccacaatgaaggcagcaatgaatgatgcaaataccatgaaccactcaatggctaccccataatatgccgcaagtcccaacaggcagaccgggcagaggatgagggacaggatgatgaccgtcagggctgtaggcaccttcttgtcaaaccatgtccactttttgagtgcctccgtaatgatggagacgataaacgccatcacaccgataaagaggacaatctgtgatacatccactgtaaaattcgtcatacaaaccactccttttctgtcattttttttgagaataatgcacaaaacaataagagcatgtactaagtacatgctcttatcttatactcattatgaaagactctttaggggaaacattttcggaaaatcaatcatcattattcatgtcaaaaatgctcatctgtcctatcattggctcatccttcagtatgtttcctatctgcttggttgtcagattatacttctctgcaagctcctttgagttgtatccgttccactctttcttgatacgcctgtttcttgccggagctatgatgttctctgtctttggaaaatagagctcatctcctttggcatactcactaagctcaatgaacttctcaatccctatgatgtccaccacagggcggtagctctctgaaatatcctctaatgtggtctcttcaatgagggctcttgttagttcatctgctaccattatagcctccttcctactattatgaggctttcttggtgtatgagaggcttatccatccggctccggacttcaatctgccccatccattcttttcctccacaatagtgtacttgttcttctttcctgtcacttcacggatggctcctactacactgtatcctgttcctgcaccggagcggatgttcagtacatcacatgtggttgtgatgagatacggtgtgaatgttgtgcctgtggatgcagctaccttcttggtgtatgagaggcttatccatccggctccggacttcaatctgccccatccgttcttttcctccacaatggtgtacttgttcttctttcctgccacttcacggatagctcctaccaccttgttatccgttcctgcaccggagcggatgttcagcacatcacatgtggttgtgatgagatactccttgaagtcatcatccttcttggtctcatccggcttcggacttccatctcctgcctgactgcttccggtttccttaattgcatccagtatcttcagtatcttttcaccatatccagctcctgccgcccatcctttgctcttcgggttctcctgtattccaagatactccacataaggagcacatccacgggatacaaggtcaaagcgttggtcaacacattcctgcttcagcttcgttgtattggcgtatgccttgaggtgttgtatctgtgcccggatgccaagctgtggcgttttgaaactgtttcctgtctctccgttctgtgtcactcccataccacagaaattattctgtgagagctccacagcacttccggagaaggtgaagttgcctgtctcaagacagctctgtgcaaatgcaatgtcaccacggatattctccgcttcaccttcagacagatacagaggtatcatatcaagtacgctctgtgcaacgctgccattctttgccttgatgtatgctgtcatctgctccgctgtagcttcagattttccggttatcttggtcatgctgtccttctgctctgtccctcctgaaatagctttcttgaaggcatcccatgtgtgctttgtcgaattatacacatacggattaggacatatctttccggtcacatcatggtgacggataacattggaagcaggaactccatacttctgcatcagatacttagtcagttcaatggcagcattgacagttgcctcttcaaagtaccaatccttgctttccgctgactgacttcctttgttgcggacacacatctcaatgcctatagagttgctattcctgcactctgcatgtttatagctgcttgctccacagtgccatgcaatgtcctcatcctcaacactctgccatacctctccattaaagcctacaaagtagtgtgctgatgctccaagatacttacttgcataatacttacaatttgcctctgctcctccaagagcccctacataatggataacaatgtacttgatacgccctgcgttatccttatttgtgaaattgtacggggtcaggagcttctcaatctttggtgctgccatttctacacactctcctctccaaaaaatcccatgctgtcagggtctaaactattgcggaactctttgagttcctcttccgtcatgttgctcactttctcctgaagctctgctctctgctccggagttatgtccttggtgtattcactaaggatgtccttgctctgttctgccatgattagtcctccttttccgtgtcatcatagtctaatgtgatggatgtcttggtctccacaaagatgctcttccggatgccctcaatgatggcatcaatcatctcttccggaagaaaagctttgatgagttccccgttcttgatacggtagatgtaccacagctccacgtcaaagtccggaactgtttccccttcaggaaccaatacagagatgagagtctccttgtccttctcaaactctcccttcagtttcttcaggaggagcttcttctgcttgtcatccggcttgatgctcatttcatcaaggaactcctcaagtgtggtctcaaaggtgtagtcacctgtgaagattgccttcatagccttctcaaatttgctgtcaaatttgtaggttgtcttggtctcctctttgaccttcatcttgtatactccctcacccacaagctccttcagcttgtccgggttcaggatgtcaaggctcatgctgtctgtgatggcagcactaccctcatcaccgtaaaacttcacatacttcacattgtggtcttccatgatagccaatcctctagcctgaagctccgccttgtagctgttcatcatagcccggctcttcttctgttcacggtcaagccacacacatgctccaatgagctgttcattggtcatgctcttcactgcctgctgttccattactgtcctcctcctaacttctcaaatgcttttgttgcacaggcttcacagatacccttcccatgaaactcatgcacatcctctgtcgttccgcaaaaattacaacggagcgtgtacggttttattctgatttcaccctgatgctcttccacaatcatagggtcttttggctcaatgccaagttctctcctcattgccaccgggatactgattgacccgtggcttgtcatcttcttgtaagctgtactcatttgtctgctcctttctaggcatccaagatgtccttgatatagttgtactggtcaaccaacttgtactcatgctcacccttttccctgacctcttcagagaactcacggagcctgatggcaagcttcagaactttggcagctcctacagcctcaagtgaggctcttgagctcatcccttctctctgacaaagcatgtaggagatggcatccatgaggtaatgctcccatataaagcagtcactacttctgccattccactcttcccttgcttcatcaatgaacttcttccggttcagcttcggcttatccggaggaagcacccctttgtcctgcatcctcttcttgagctctgcccttgcctgcttctccttattggtcaaccgtttattcttcgccactatataccactccttcctcttatgagctgtcatccgggtcaagttttcctgcccggagctgttcctctagcgtttccattgcagcaagatggatgtcaagcatgttgttcttcacatcatccatatccagtccacgtttcagaccttccatgccaacgaacacctgaaggaagcctgctatctgtgccaactcctcaacactgatgtcctgtccctcaaagttgaccttgtcatccctgactgtcactattagcttgcaatccctcatcctgctcctccttctccttctgcctcttcaacatactcttcagagcttcaatgagctttgagcattgctgatagttcagccactcaaccgcactgacaccaaacatcttctgacacattccattgacccttgcaggcttgtcccatccaagctcttgtgtgagcttgtatatcttcttccgttggttctctgtgacttcacttccgctgtatcggttccttccacgctctgacttcttagcagagtccttcatgttaccaagtacacggatgacagtctgaagctcccttttgttgagagccttgatactgtcctttcctgtatgtgcctgaacaagaagatgcagctcctcatccgtgagcttcagctccggactcttggcaatcccccacaccctcttgatacttggctgtgatgtatttcctgccatactatcctctctttctcttatcgttcccattctcaatgactccgcctcttgcatactgcgtcaggaatgtaggtatctgtatatcctttctaggctccgggatagtatctgcacacagattgatgtcacagtatccatgctcattgattgcttcatatacgctcttcataatatgttgagcaatctgctcttccttctctccactaagtgcaatcttaatctccttcatagaactctctccttcctacaacatcatcatgttggatgcttcactcacaatcttcatggttatacgggtctcacccttctgcttcaggatacggagcacgttgttgagcgttctgtccaacagacggaagcatccgctttgtgtgttggttgcccggcttatcatctcacccatggcagcctcatccacctcatatccttcaaggtagtcaactacttcattctttgacagtcccttcagcttgtagtagaagtccatcctgttagcaaaccgggcaagattgcccttcagctctgtctcaagtctcggctctcctgctatgacaatgcctacattcgactggtcaaagataccacggagtatctccatcttcttctgtgtgtacttgttgatgagcttgtctgcctcatcaatgatgagtaggaacccttcattggtattgaaaaactcacggatgcggttgactctgctccatatcgttccaccgtaaccctttgggagtcctataccgttctcaatggcttccaccaagtcccggcaagccattgtgtcatcacactcaatgtatgccacccttggaagctctgcatatttcttcagggcgtgtgtctttccctgaccggactttccaacgattatcccaagccccatgtactcctgacatgcctgacacacaccaatggtctgcacaaagtctctgctctcaaagaactccaccttcttcttgagtgtgcctgctcctgtaggtacgctgttctccggttcctgaccttcagcaacgcctccggtagcggcaagaaactctctgaccttcttctcaagctctgtagggtcacttgcatacttcccattgaggtactgactaagtgctgctcttgagtagttcatcttgagagctgcctctgccttcgtcatcttcatctccgccagtctctcattcatctgctctgccaatgtcttctctgttttgtaggtattcaatgcttccatgtttacaaccttcctttccttcaaccttatttcatattttccaagtacgccgccgcaatcgaaaatgccaaccacgccaattcaaccaatgctataactgccataaccacaagggcagctccaatcaatatcatcctgaccatatcatcctcctatagctctaagcttcttgagggcgttttctgcctgcctgctcatgtattcgctgtccgcttcaggctcttctctcttctcggctctgaagccctgctgataggttctgtctgtaggtatcgtgatgacctttgcagccttctcctgcttctttccacctatcatcagctcaataccacctgtagtctcattgaagccaacatactgctcattgagttcctcaaacggtctccttgcctcttcaagtctttcccggtcacgcttctgctgtctcttctgcatcttcaggtgctcctcaagagctttctgtgtaaccttcggagctatctgaagaagctcctgacaatatgcttcacagatacgcttgcccttttggtcaaagacatacaggacagccatatcatccgggtcatacttgatgtcaaccttccgcccgatatagtcacaaagctcatcagagcggtactcatatccccacttggtaatgccaatgttacggacaagcacgttctctgacttcatcatcagcatggttgcatagctcttaggcggtgccgccttgaagtatctgtcctcattcataaagcagtcataaggcttcttataagtctctcccatcttcttcagtccggagtgttccgtgtgcatgtagaccgttgtgagccattcatgccacttctcatagaactcttccagtgtcaggagttctcctctctcaagcatccgcttgatgtccttatccaccttgtcagaggtctttgagcctgtcagtgttccggtgtatgacttcatccaacgtgtgaacttattgcacacggtacggaagaacctctcaatctgacctttgctccatggctcataaggaagagccctgtggtcatccttgatgcctatactcttgtagaagcccattgtctcattgtcaaagttcatgccgctccggtcattcctgtctcttcctgtcatggtcttggctgtgtagtccttaccattgtctatgtagagatactccggaactccgcccggctctgaatatatcattttgagtaggctctgcttcaggatgtcagagttggcatccttgcacatcacatctcccatgatgaccctgctcctcatgtctacccatgcagccaagtgtggcttgatggctataaccttgccattaggctgcttgtagctcacccaacagtcaaaggtatgctcatcacccatgacaatctgcatcacctgaagccccttggtgtctctgcttcctttcaccatgaccttattcttgtactcacgggtaccacgggatgcaaggaaccaagcgttcctcatcccctcatcctccatgaggtaactgatgtaccttgtcaccgtctgataggatggtatcttctcccacttgttgatattggcaatggctgtcagcttctcatacagcatctcacgggttccttggtttcgggcaaagtcctcattgaaccatatattcttgataacctgtttgacctccggcttgatacttggaaagcatccggtttcttttggcttccggcacaggcagagaaccttgaagaactcacgccctgctccgtcttccttctcaagcttgtccgcccatgcggatgcttcaaggtatgccttggtgtatcggtagagtgttctctgaccttttccaagatacttctgtgcaaactcttcagcgtactttgtccggtctccttcgtcatactgaaggaactttctgaccacgttcccaagctccacagccttgtagtatctctccttgtagttttcaatgtaccaatcaacatctgtattcacataccatggaacttccggcttctgctcatcctctttcttgtccggaaattcttccgtgaaagatttcagcttctcccgttccttccatgcgttccttgcctgctttgaaagtgaggagaccgccacaagtaccacatcttttccgccattctctgacttctcggtcttggtcacaaaggactcttgcttccttaataccctcttgaccattgtgttgtacttaactctttccagttcagcagcttctcccaatgtgacatatacttcagccaatcagctcacctccttcatgctgctacctcaatatccagtatccttgatattgcctcaatgtatttctttccactacgctcaccgactaaaatcttatggatgtactgcttattgcatccaagcaaagcagcaagctccacctgtgtcatattcttgtctatgagccttttcctgaccttccgcccaaagggtgtcagtctcgtctgctttgttgccatctgctcacctcacatcacagcttgtataccctcataccgcaaccattcaggtcacaggtgtatcctttttctataagggtctcaatgacttttggagccgcctcatacaggatgataccctgacggactgtgccgcctactgtgtatcctatggacatcctgatggggcttgtctgttcctgaagcttcaggagtattgacatcaactccacatcactatccttgtatttctccattacagcctacctttccaaccaattacaggctctttgatatagtccttgtctttggttttcctccaaccttcttcagagatacccggctcactacttccaatgagtccggaaggttcttgaccacaagccaattctccggcaccaatccatgagccttcattatcttcttctgttcccttgtgggagcctttccgttcttcatcagtagctcacctccgtcccctctataattttgtcaattatattgagagcgttttcctttccctcaatctctgcctcaagctccatccggttctcccggagctgctcaagctctgcatccaacttctctctgtgctcaaccaatgcttccatttcatcacttgacaggttcagcaaatgcctcatctcctctctatatatttgaacatcagggcttcaagctaaaactccgatactgacaagcatccgctttgtcatccttctatcacggtcatagaacttctgccccttaatctcctgattgacatagaatgtaccgcacaggtaccgctttatcatccaaaccttgtccgggttatacttgtcttgtatccttgttaccttcataaaaccttcctttccctgatgccactgtctcattcttcaactcttaaagtaggacaggacagctcttctatctcttcctgtatccgttgcacttctctctgtgcgttccggaggagctcatcaagctcatgggctttctttgctcttggaagcatgtcatggaagattgtcataccaaagctcttatacagttcagcaacttcatctttgccggatgtgttccggatagatggatgccacatgtagacttcttcaatcactttgtactgctcatccgtgacagttctttcaattctttcctcaaattcctgcttctgcatcctgcacctccttcattccttcatagttccattttctgataccctgaaccgggtgactttctttgtgccggagaactccgactattgagatttactaagttttttgatatgatttatcttggattagtgggttacaagtaacccttgcaaggtttattatatcttcctatttgcagaatatcaacactttttctgctttcaggaagaatatatattccaatttgcagaaagagaggtcatcatggaattagatatgatgggaattggtgaacgtattaaaacaagaagaaaagaattgaaactctctcaaacagacatatatgagagatgtgacatcacttcaggagcattgagcaaaatcgaaaacggaaaaactacgccttccgttattgcattttataagctttcacaagtgttagagtgtgatatgaattggttggcaaccggaatatcttccaatatgcagaagtccaatatctgcaaattggaagaggagctgttgaatggtttccgggagcttcctgaagatgacaaagaggaactcatgggcttattgcaactaaagctccggaaggtgaaaaaagaaagagatgtgactgcaaaatcatccggattgataggtacagaaaatggtgacatggttggctgatttttttatgcttttttgggttacttgtaacccttttattgtcactttgctttttagggaagcaattcccgaaaaagttcatttttccttgaaaataagccaaagtgacaactttatttgcaaggttccaatttgtcactttgattgcatccagtcccggctctcctgttccgtgtactgattgcattgagtaacgcctttttttcaaagcgttactttcaaaaaacccttattttatgggactttacgaaacaaacacgcacattgacaacacttaatcagtaacgcaataacgccacgttataacgcttgacctattttcagaagaggatgcctgatgtataatgtccttacaacctaactttgaggtgttgtggatagaacaagtgctcaaaaaccaagtaaaaccaatgcttccaagcactctatccacttccctcccttccaagggcacaaaaaaagcatccgaaacagcttattctcaaattcgctgtcaaagatgcttcattttttctctatgaaattcgccacaaaccttgatttcacggggtttcccgtcatttcccacctcttcacggatggtctcacgttagaatgtcctttttgtcagatattctgttaagttacaatttttttccagttcagtgaacatttttaacactatgtttcttattctacagactaactatgttgcatttcattatttaaatattcagtgaaaaaaatctccgcttctccgcttctattgattttaaaggatttttgcctccgctttggcctttaaaacctccgctttccctccgcttttgctccaaaacctccgcttttattttatgtcaactaattgaatggtatttttccttgtgtgtactcttcctgtgtaacgccttggaatccctcttccttctgtttaaggttcctgtacaccatcacgcccctctttccctccatattagccttgtctgccgggcatccgttggcctccatcctatcccggatgttctgcttattcacatgggcgaactcattcaacatgcaccagttcatatatgcgctgtcaaaatctgccttaagcaccatatccgccctgtctcctgtaatgatataaaattctgacagataacggaaaacagtatccagcttttcatggtaatcctttatggcttcctcacaggcagaggaatgggtaattttaaaattgtggtcaatcagcctgtgcagcccttccaggaaccagttaaagatagcgttgcgctcattcagtatcttatccagtaatgcactgtcccggcgttcctgctctatggtattcgtgcagggcaccacacacaaccgttcaaagatatgaccgcccttatcatcctggaaactagggagattgttacaggctatggcaatccctccagggactatgtaataaaatggctgtttattctttggttctatcttcacagcgtccccgcctgtaagctgcttaaatacagagctgtcctttatctcactgcccgtctggtcccctatgcttatcaggcgtttccctatgatgctccccagggtgaacttggaagcctcattcatctgctggatggggatgttcgcaatcttatctgtccccagcagttcacccacaaggttaagtatctgcgtcttaccggaattacccaggagtgaccacagcaccagggccagctttatccggtataccttcacattggagaggataagccccatatattcctgaatcacggccatcttctcctggtccaccttcccttccctgtcgctgcacaggtcatccatatagcggtcaaacactggccgggccgtgtcctccgggtggtactcgcaattaagctgcatcgtgctccgcagctttggcgtgtgcggctccagcttcctggtttcaaggttatacaggccattcttaagatttatatatttctcgtctgtatccagttcccggaacgtacatatattgctgtccttacataagagaaggttgtacacattattaatcatgttgtcacttgccatccccacggggacataccgccggataagggattttaccttgttgcggttgcatttgttatataccccgtcctcatacaggtagaaatcgtccctatcttcctccggcctcctgactatcagatagggcagaccacggctgatgctgtcagccagtatgtccccatttattctcaccttggcccgtgctccctccccatccgtgaaaagccatggagcaccccggttttctgaagctgctatcaactcgtcaagttcttccttgctatgaccttcctttgtaaggtaatctgtcacatcccctttatcagctaaggacgtgattgtccagcggatggaatgagcaaaatgccttaaatccctcactatctggtctttcagcttcattcccggttcatcattatcagggagaattaccacctttgccccagcaaaataaaaagcatattccctgcgccaatcgctggtgctgccggctgtagttgcggtataccccagcttgttcagggtatcggcatccttctcaccttccacaatatataccggataacctgccttgacggcccttatcagggaaggaagattgtataatactgcatggtcagttttcttgtggtacttatatgtatcgttcttccggtctatggtgacgtaccgtattttctttccctcaaatcttaccttggaatagagatagcgaccctctgccgtcttataatcatatatggcttctatggtcttgccctgggcaaattccagacgttccttccactggggcggcctgtagtcccctaaatcctggaatgacaagcctacttcctccaggatgtcctttgtctcgcatcctgcatgacagtgcagcagcaatttgcctttgtcctctgatatggtaaggcttgccttgctgtcataatgcaccgggcatttacattggtaagaggccggaccaatcttccttgatacctcaaagtgtgtcaatagttcctgtaatgtaatcatatatcgcctgtgtcctcccacttccgcagtaactccctggctgattccaatgcccgcagcgtgttcctgcccctgttctccagcgtctttatgaactccttgacctcccggacgttcccaggcaggaaataccctccgtcctcctgacaggtggaaagtatgacggccccggccgccctctccctggcaatctccttttgcagctcccggactgtctcaactcccaggcggttacatagagcccctgcactcacggcattttccttgccctcagggagtacatccgcaacaatcatccatggttccttcctatttacaggttccacggttgccgccgctctctgcactggtgtgtggtcctgatgttcttttttcagccctgtgtaatattcattgttcatggtttacacccccgtgaggttattaaggtactggtcaaccttcaccttgtcccacaggacacgcttccctatcttaacctttgcgccgatttcctcccccagcttcattgcattgttgcgccccaagttggtatatgcccgtaattcctccgtatccataaggcggctctctccggctaccatgttcattgctcgtgctctcattgctttgactcccttctacttgtttatctctgtttaaataagtattgaaaaccatgattacatctgttacaatatgtattatacaacaacatttgtattcattcaacatttgtactcattatattttatgtttcaacaaatttgagctcacataagaaattggaggctttacaatgggatatgcaacgaaacgtttttctaaacgcttaaaacagcttcgagaaactgcgggattgacacaagaacaatttgccaaagagttaaaagtatcaagaggcgccataagctactatgaaaaaggagaaaggactccagatattgagtttttggactctttgtatgattactttaattgcactttaccagttgattaccttcttggaaatacggacaactatcgtgaagaacacaaaaacatgtttgatttttacggactaactgataatgcttgtaattacttagaacggaataccgatattggtattattatttctactatgttagaagatgatgacttttatggattaacccaactttatcggagcacattggaaaatcatgaactttttgattatggccaaattgaatatataagctttttaataactcagtctttaaaagaaataatttcacggattttacacgcaaatatttataatcagtttactgataaagaaaaggctgatattaaaaaagaaaatattgaaacagagcaacggctcaaaaaactttatgatgaacatgaaaaatttttagaagaatctcgaatacgttctgataaagactgggagatttacaggaaagaacacgccacccaacttgaaactatagaaaaaatacatgaacaactttctgaaataggtttgcactcctcaatttagtctatctacaagccaggcgcattccctcccccgcctggctcttttcattccgtaaaatcgattgtgggtaaattgtgggtacacacccctttcaagcagaaaccagcatagcactcaccccgcaaaaaatcagccccggcacaccattgcgccggagctgatttaaaaaggggaggataagtattaattattttctctttcgtgtatactcctattatggccccgttccaaagaattatacacacctgcaaaacttttttaaatttttttctccccaacccttcctggcctccccgctgtatcttccggcagccgctcccataatgcctacaatatcatcatcagcgtcccggtaatcaaaaccgtgctgattaccacggatatggagttggccgcgcttgccagtcccacatccgaattcaggttccctgtaaatgcaggcgcagcagaggacatggggctaagggcaagtatggtcaatgcctgcctgtattccatgctaaatggcagaagaaagtaaaagattagggccaacgcaatggccgccgaataccgggccgcaagtatcttcacgattttccccagctggctgctatcaccattcagcttaaacccaaccccgatcatgagcatagccataaatgcgtttgcatttccaatgactccggtaaatgtggtaatgggcgcaggcagtgccacatgaagaagcgacagcacggtcatgagcagataggcgtcaaagggtacggatttaagcagcgtcttcataaccggcagaatgctgaacctggtatttttctccttaatcatcactgcagcgctgtaggaccctcccaggcagatgaacgcatttccggtatcaaataaactggtagccaccacacccatgggtcccagaaaaccctgggcaaagggcatggtgaaattgcctatattgtatccgggcagattcatggtattgaatgcccattcttcccgtttcttcccaatactcattataaatgccatactgatatacagaattcctccgccaaatcccaacagcgtcatcaccagcatggagggcttcaggtcaattccggaaaaattagatatgattgctgcgggaagggttatcctaagtacgatttttgataagacataaaaatcctcctctttaaaaaaacctgcccttctcagcagatttcccataattattacggccacaaaggacccggccttcatcaacacttctgccattttgccaattctcccatccgtttactctatccgccccaatataagcattctatatttacatttcacgtttgcattacccatttccattccccttctgccgcatcactcaactgcgcaggtattagggcctgttcgaaaattcatttctgccatctgcgcaccctagtaataatatcaaaaacagcggcaaactgcaataacaaaacaagaacccgcctaaaagccggaaagaccggcccccacctggcgccggtctttccaaacccttatgaaataatgcgcgcagccttacatgcgtcccggtccgcgaccctccgcagaggctgtttcatgctaagaactcctgtaccgcctatacatatcccagcagtcccggcagccacatagacagaatcggaacataggatacaagcagcagcacagcgaatatggctgcaaaatacaataacagcggcttaattacattttcaatcttggtcttacccaccttaacacccacaaacagcgtggttcccaccggaggcgtgatggttccgatacacaggttgaatatcatcatgataccaaagtgtacggtattcatacccagggcctggcagattggcaggaaaatgggtgtaaagataagacaggcaggcgtcatgtccataaatgtaccgataatcagcagaaggatgttgatgatgaaaagaatcacataccggttgttgctgatacccagcattgcctcggatacggctgtggggattcccgtaaaggccatgacccagctcatgatgctggacacaccgataaggaaaatgatgatgcctgtcatctcagcgctgtccaggaaaatcttaggcagctcagaaaacttgatggacttatagaagaacagggacagaatcaggctgtacaccactgccaccacgcttccctctgtagccgtaaaaataccgctgataataccgccgataacaataactatcatcagcagacagggaatggcctggaaaaataccttcaccttttcactgttggaatatttcctggtgctgcggtaccccttcttctttgcaaaatagaagataaccgccatacaggcaagcccccagaggatgcctggaatgtatcctgccatgaacagggctgccacggatgtgccgccgctgaccagggagtaggtaatcataacattgcttggaggaatcagaaggccggtgggagctgtggcaatgttggccgccgcagagaaatccctgtcatatccttcctcttcctcaatcggtccaatgatggagcccatggctgaggcggctgcggtgccggagccggagatggcgccgaacagcatgtttgccacagcattggtatgggccagggcgcctggtatgcttcctgtaaacagctttgcaaagttaatgagacggatggcaataccgcccttattcatgatatttcctgccaggatgaaaaacggaatggcaagaaggctgaatacggatatgcctgaaaaaattctctgcgcgcccgtaagcacggctgcccctgtattgagcaccggaaggattgcacagatagatgacactgccagggccactgcgatgggaactcccgccaaaagcatcacaaccaaaagcactaaaataatcagtccgcagactactgctatattcatacccctgcatcctccttttttctgaaatccgtgtgcagcatgtctgctgcgttcatcaggctgaacatcatgatgatgatgcctgtcacaggtacaatcacatagatatatcccatgggcaccctgagggatgcggtggtctgaatcatggtcagctttgtgatggcaataccgccgtacaccatgacaacaccggcaaaggcaaaggtcaggaggtcaatgatgacttccaggtatttctttgcggtaccgctaatcttatctgccagaaatcccatcctcatatggtcccttttgccgaacacataggcggaggccagcagcgccatccatgtgaagctgtaggtcagaagttcctcggaaacagtacttggcttgttgaagaagtagcgggtaacaatctgataggttccgattacagtcatcagcataaacaggcagatgatgaaaattcccagaacctgcatgattctggctctcactttatgcattgtctccattctactttcctcccttcgctttttcatttatttcctggatatggttgtacaaatccacaatcttaggattatcatttagcatggtctcatgcagaggcaggaccttctgtttgaacgcatccacgtccacgtcgataaattccacgcccatgtcattcatggcaatgtccttggcttcctcaatgctcttatcccactccttaagctccacctccgtggacagggcagccgcgtccttgaatacctggtactcctcaggacttaagccatttaagaacttcaggttggcaaccagcatatccggcaccatctggtgcttgttgtaggcataatacttggcaacctcgccgtgcttgttgttggtaagcgccagctcattgttctccgcgccgtcaatgacgccctgctggatggccgtatatacctcaccaaatcccataggggctgctgctgctccaaaggcattgaccatggccacgctggccgggctctgctgaacccttatcttctttccctttaagtcatcaggggtatggatgggggtcttggcataaaaattcctgacgcctgcgttgtaccaggtaactaccctgaatccggcttcgtccgtggactcataaaccttttccatgtaatccgtatcctgcataacagacttgtacacatcctccgagtcaaaaagatagggcatactgaaaatttcgtatacgcctgcaaacgtctcaagattggcggttccggccacaacaaagtcaatggcccctgtctgtgtcagctcaatggccttctgggcagaacccaggatttcattggggaatatctgaacctcgtacttgtctcccagccgttcctccacatattccttaaaagccagaagtcctatgtgctccggatgtgtctctgactgggcatgggatacgcggattatccgctttccggaagtcactgagccacagcctgtaagacctgctgccacagcagccgcaagcgcggcaaccgccactctctttatgaattttctcacttttttcattcctttcccttcatacggcgaattcttttgtttcaatgcatccttgaaacctgcgttcctgtttattctggtctgaaatactgtttcccatactgcaaaacagcggccttttactgcctgctgccggactccctaagagtcccggtccttttcctccacagcaaaagccccttggctatcaaccagaaaacgttaagatttattggcgccttcttaacactttcttaattatatagccaggggcctttaatttgtaccgtaaaagtttgtcatacgggaagaagattttgtcctcccccatttttttctagccaccttcgcacaaatgcacaaaaacctgcgtctatttttgtgcagtctcactatccctatactcggatggtatcattccggtcatgcgcttgaacacttttgcaaaataattggaatcgtaataccctacctgcatgctcacgtccttgacgctgatacgcctgtccctcagcagcttcttggcctcattgaccctgaagcctgtaaggtaggatgtgaaattctggtcaaaacattgtttaaacagcttgcagaaataggcgtccgaataattcatcatcctggccgcatcctgcatggatatctccttcatataattattccttatatattcccgtatggtttccgccacctgggccagacgcccgtccccgtcgtccctgggctggccttctgccggtccactgccgggccaggctttttccgggctctcatccccatccggcggctcattgtctttccccgcttctgccagccgcttatccgtcagccgcttgtccgtcagccgcatggcctcctccatgacagctaccagttcctcctcctcgcagggcttcagcagatagtccagtgcccggatgacaatggctctctttgcataggaaaactcgtcatacgctgtcaggaaaatgatgatgcagtcctcatccaggctgcggatgtgctcggctgcctccaccccgttcatctccggcatggatatatccataaccacaatctggcttttttcccttttatatgtctccagggcctctgccccgtttactgcctcgctgatatccaggctgtcgccaaaatgccgcttaagacgcttggccagcgccatccgttcaatctgttcatcatccgccagcaatacacgatacatatatcccatcctttcgtcctgacatcagggtgtaaaggccatctgcacgaccgttccccgtccctcactgctgtatataaaaacctcgccgtcctgatacatgccatggaccctgcggtatatattcccaaccccgacgccggtggccttctcatccccctgttccagggccatgcgtatttcctccagccgttccagggccattccccggcccgtgtccgccaccgatatccatagcctcgctcccctcatccatgagcgcacatgtatcctccccccctggcctttgggggaaatgccgtggataatggcattttccaccagcggctgcagggcaaaggaaggcaccagcacctccagggtgtccgggctgcagtccgtgtcatagcggattctctgcccaaaacgcatctgctgtaaatacatgtagtcctgcaccaccttaagctcccgccccaggggcatcacggaatccgtggattttagattatagcggaacaggcggctcagggcatttatcatcttctccgtggcggccgcatcctcaatctgtgccgtgctggcaatcatattcagtgtgttgaacagaaaatgaggattaatctggttcttcagcatctgaagccttacctcgtccagctgcttttccatcttatgcttttccgtcagggcttcgatgtatcccctggtgctggccttcatggtgcaaaaggccctgaccagactggcaatctcatcctccccctccgcatgggtgtcagggcctgtgaaatcattttccccaatccgtctggaatcctctgccagctccaccatggggcggacaatgcttctctgtacggagcggttcagccatctcaccatcaaaagggctgccgcaccccacaggatgctgaccacgggcacgatgatgaacaggggacgctgcatctcataccgttcattgcctgattccacagtcatctgctccaggcgccctgcatgggtttccagatacccctgaacccggtaaacggtgtagagcctgtccagataatccggggcatcttcctccagctccagaaacgcatccctggttttggcgtaattctcatacatatttaaaatagaccaggtggcgccgtaccgttccgccccaatctcctcatagtcaaaaggcagggacttcagggctgtccgggtcctggcacaggacatctcatacttctccctgttctcaggcgtcctgtctcctgcataataccggaaggagctgctttcagcatccatggccgaccaaaaagccagactccgtgaatttcccatgagcaaatccccgaatcccttcattccatagcccgcaaccagcattaccgctgttatggacaggatgaccacggcagccgtggaaatggtaatccatcggaccttccgttccagggagcaggacaaccaaataccatgcagttttcttccttgccttcctttcatgcagtctacctccatcgctcatagcttattctataatagattttaccattttggaagagacaaaccaaaaacatgacggaactttgcaatttttcacagcaaaaaacgcctgcagccggtaatataatcttccatttaccggcatgggcgttttcctgcgttttctgcttttcctgctcttttctgcattccccagcttatttctgggctttccagccataagccgcgaaccatcacagcagctggtccttttcggaaggcacatacattgcaatatcctcaatatcgcagtccagtatcctgcaaaggtcattcacagtcttcatggatatatccatgttgtgcttcagcctgtgcagggtactgtctgacacgcggtgcttctttgtaagtgtgtaccaattttcctcagattgctccagtgtcttccagaatggtgaataatctatcatctctatctcctgtatacgctcaagccgccgaagggctggtttcttagatagattaagcataagttagatttcacatcttgaatatcttcgcaattacgaatatactatataaatgtaaatactctcatttacatatctgaaaggcaggacaagacaaatggattatttcacaaaggaaggcatggaaaagcttctggaagatgaagaggtagtccgccgtttgacggagttcatggccatggatggagcggcctatttcgaggaggtgcgctcccgcctgtcaccggaggagctggaagaatatctggaggaaaacccggatgaaagaatctacctgaaaaagtaggtgtccgtcaaacctgttcctcacgcaaaagagcggcctgtcaaatgacaaaccgcccttcttcattttcttcctcaaagtaatccttatagtccacctcaatggaatgacgcatacgtttcatgctgtaatagagatgttccttcagggcttcctccagcgccttttcatttttatccgcaatcaggcggaacaaatcctcatgctcgccaatgatgcgcatgaaatccgtctccgtgataaaatccagcatcctgaacctggtatagtggagctgctgggcctggagcatttcccacagcttctggcgcctgaccgccccaaaccagatggagtgcatctgtgcatccatgcggtaaaactgctccggctcaaaccccggttccctgataatggcccgctgctgggcaatgctgtggcggatatcctcaataaccatgggggtctgtacctccaggaagtccctcagcaccatggtttccacagccacccgcatatatatcatctgtttgatattatccaggctcagaagggtcacataggtgccgcggtagggaatggtctccgcaaacccctgctcctgcaaaagacgcagggcatcccgcaccggcgtcctggacacaccgaagcgctcgcatatatcattctcactaatcatctggcccggtttaagccttaaatccaggatttcctgcttaagtgtctcgtatacaagctctccccggttcttgaagttcatctctcccatggctggacccccttatcaatacctgcacacagcataagcacaaagtacgttttttcttatcaaacagtccggccgcatcaaaagctgccggactgtcaactggtctatattataaatgattcccctgcaaaattcaagccggattatttaggctgcttgccgatgtaagccaggattcctccgtccacatacagcaccaggccgttaacgaaattggatgcatcagaagccaggaatacagcaggcccgcccaggtcctctgcctcgccccagcgtcctgccggagtcttgcttacaatgaactggtcaaatggatgcctggagccgtcgggctggatttcgcgcagcggagcggtctggggtgttgcaatatacccgggcccaatgccgttgcactggatgttgaactcgccgtactcggaggcgatgttcttggtcagcatcttaagtccgccctttgctgccgcgtatgcggatacggtctcgcggccaagctcgctcatcatggagcagatgttgatgatttttccgtggcccttcttaatcatgctggggataactgccttggacacgatgaacggggcattcaaatccacatcaatgacctgtctgaactcagcagccgtcatatcgcacatgggaatcctcttgataatccctgcgttgttcaccaggatatccaccacgcccacttccttctcaattttggaaaccatctcattgacagcatcctcactggtaacgtcgcatacgtagccgtgcgcttcaattccctcttccttgtaagccgccagtcccttgtcaaccagttcctgcttgatatcattgaacacgatggtggctcctgcgcctgccatggcctttgcaatggcaaagccgattccgtaggaagcgcctgtaatcagggctaccttgccctccagtgaaaagttatttaaataatctgccatttctttttcctcctcgttttaattatttcatctggtttggcatcatggtgtccatgtcgtcaaactccatgttctctccgcccatggcccagataaatgtatagttggatgtacctgccccgctgtggatgctccaggaaggactgataacagcttcctcgttcttcatcacgatatgccttgtctcggtaggctctcccatcatgtggaataccacattatctcccggaacctcgaagtacatatatacctccatacggcgctcatgggtgtgggccggcatggtgttccatacactgccctcttccagtacggtcatgcccatggacagctggcaggtcttaagtacgtccggatggataaactggttgataacacgcttattggctgtctcagatgctccgcagggcctcttggctgcctttgcaatggggatgaatgtggtggtgtaagaagtgtgggccggtgcgcttaccatgtagaacttagccggtgcagaggcgtcgtcgctggaaaaatatacttcctttgttccctttgtgatataaagacagtccttatatcccatcttaaattcctgtccgtcagccacaatcacgccgctgcctccaatattgaaaatgccaatctcacggcgctccaggaaatagcgggtgccgaagtttttccagcagtcaattcccttatctatggaaacagtctctgtggtaggcatacatcccaatgtcaccatgcggtccacatgtgaatacactgccactacctcattggccacatacaggttctgaatcaggaactcatccctcagctcctgggtggtgtaacgctttacatccctctgatttgcagaatagcgaatatccattatcttgtttcctcctttaaacttgacttcctttgatttgtatttgttctcttttacttgtatacaactttttaaatctgtatacagattatcatagtagtatatcttttgcaatgggcatattctacaaaattgcagggattttctatgcatgttcactacagtaagacttgcgttgtgtgactgtttattatatacttgaccgtgtttgaccatgaaacattacagcgaggagaatgaatatgaagaaaaatatcctggtgggccagtccggcggccccacagccgtcataaacgccagcttatatggagtcattgcagaggggatggcccggcctgatgagaccggccgtgtatacggcatggtaaacggcattgaaggctttctctcaggccatgtggcagacctgtcctctcttaccactgaggagctggtcctgcttaagcagacccctgccgcttatcttggctcatgccggttcaagctgccagaaaacctggatgcaccaatctaccgtcttttatttgaaaaatttgcatccatgaacataggcgcctgtttctatatcggcggaaatgattccatggacacggttgacaagctctcccggtgcgcccaaatccgccatgaatccatctccttcataggagtgcccaagaccattgacaatgacctgcctgtgacagaccatacgcccggttacggaagcgctgccaagtatgtggcatccacggtccgggaaatttccctggacgcctccgtgtaccagcagccggctgtaaccattgtggagcttatgggccgccatgccggctgggtgacagctgccagcgctcttgccagaaaataccccggtgacaatccccttctaatctatatgccggaaacacccttttccatggagcagttctttggggatgtggagcaggccctgtcacggcagcccaatgtggtaatctgcgtatccgaaggcatccgcgacggaaaaggccgttttatctgtgagtacaccaacgacgcccagattgacacctttggccacaagatgctcacgggctgcgccaaaatactggaaagctacatccgcaaccgtttccatgtcaaggtccgctccgtggagctgaatgtcaaccagcggtgcagcagtcttctggcctctgccgccgatgtcatggaagcagagcattccggcaggaaggctgtagaaaaggccctgcagggagaaaccggcaaaatggttacctgttcccgcctgtcagggcctggatatgtacttgaatatggactcaccccggtgggcaatgtgtgcaaccgtgaaaaatcctttccggcgcagtggattacggagaacggctgtgacatcggaccggaattcctggactatgcccttcccctgattcagggacagccggaccacattatggagaacggactgccaaaatatctgtaccggaaataatcacagggttcatacaaatacattccttattccaatgcagtccttagcccctccaatgcactctccgaagtccattcgtcacaccccggagtacgcagaaaacccgccgtccaccggaagtatgattcccgtgataaaaccggccgcctcattgttgagcaggaacaggagggccccgttcagctcctcaggcttaccgaaccgccccatgggagtggcggccagaaccttggcggtcctggccgccggccttccgtcctcctcatagagaagtccttcattctgcctggtcacaaagaatcccggcgcaatggcattgacccggattccggcctttgcaaagtgcacggccagccattgggtaaaattgctgagggcagccactgccccgctgtatacaggtatcctggtaaggggcctggccgcactggcggaggaaatgttgatgatattgcatccctcccgtcccaccatatccttggcaaaaacctggcaggtgagaaatccgcctaaaaagttcaaatccagaaccccctgtacgcccttgcactccatgtcaaaaaaggtggccacatcggcctcaatatcccccatctcaaaatattccttggttgtattggccctggcctggttgcctcccgcgccgttaatcaggatatcgcagggtcctaactgggccagcaccctggcgtgtacgctttccagcatttctttgtccatgacatccactccgtaggcagcagccgtaccgccggcctcccgtatgtccctggcagtctcctcggccgcctccagatttatatccagcagggccaccgcagcaccggcccgggccagggtcctggcgaacatgccgcagaggattccccctgctccggtcaccaccgccatctttcctgttaaatccgtccccaataccacctttccttcctcctctctctgtttccgcttatccttgcaggataagggagaaaaagggcctgagaaatctcttcccggccctttcctgactcatactatattttctgtctgattttgcgctgtccggacattaccggcccatcttctccacagcctcgaacaggccgttgagataggtggcgcccaaggctctgtcatacaggccgtatccggctcttcctgtctcgccccaaatcatacgtccgtggtcaggtcttacatatccgtcaaacccattctccaccagcgcctttacaatgccgaacatatccagggaaccgcagcaggacagatgggccctttcctcaaagccgttgtccagcacagccacatttctcagatgcgcaaaatggattcttcccatggcagcatacttaccggccagtctcaccacatcgttcttggcggagcagcccagggagccggtacacagtgtgattccgttgtgcctgtcatccaccagctttaagaacttatccaggttctcctcacaggtaatgattcttggaaggccaaagatactccagcatgggtcatcctcatggattgccatgttcacgtcgcactcagctgcaaccggaatgatgcgctccaggaaatacttcagattgtcccacagattctcctctgtcaggttgtggtattcctccaccacagccttaaggccgtccttagtatagctggaatcccaaccgggaagtgtcaggtcgctgtcgctgttaagaggatttactgcatccacctgctcctgatagtacaccagggatgtggagccgtcagccagttcatggtctaactgggttctggtccagtcaaatacaggcatgaaattgtagcagatacatttaacgcctgcctccgcaacacggcggatgttctcacagtaattctcgatgtacttgtccctggatgccttacccagctttatatcctcatggaccggaatactctcaatcacgtcaaagcccaggcccgcatcctctacctgcttcttaagctttgcaatgctctccctgctccacacttcgcctacaggaacatcgtatacagccgtaacgatggactgcatacccggaatctggcggatgttctccagtgttaccttgtcgtcttccccgtaccatctgaatgataatttcatgtgtaaactcctcctaaaaagtgttgttttacgttccctaacctatggctttattataacagaaaccctgtttccgtccatagtgatacttgccgtccatattgcaaatgttgttgtttcatgctaagatggggataaaatcatgatgaatcatgtttcccgagaggagggactcccgtgaaaaaacagctgtccatggactttaacacgcggcaatatatgcagtccggagactttgaactcttctattacaatgacaccgcgctgaaatccgtggatgcccatgagcatgactactacgagttctattttttcctggaaggcgatgtggaataccacattggtgataaaagctatcatctggaatacggggactgcctgctgattccgccggatacgccccattatccccagttccattcccatgataaaccgtaccgcagattcgtattctggctgaaccaggattaccataacaggctccgccagaccgatgaagagctgacctactgctttgactatgcccagagccatcagacctaccggttccacacagataccatcaccacccaggagattcagggaaagcttaccgacctgatggaggaacgggtgggcggacgctccttccaccggcttgtctcagagcttatggcagtctccttcctggtatatgtgaaccgccttctctatgacagtctgcaccagaaatcagctgtctatgaaaatgttctgtacctgaatatctgcgattatatcaaccggcacctggaagaggatttaagcctggacagcctgtcatccttcttctatgtgagcaaataccatatttcccacatattcaaggacaacatgggcattccgctccaccagtacatcctgaaaaagcggctgcatgccagcaaaaacgccatcttgtccgaccagcccatcagccatgtgtatctccagtacggcttcaaggactacaccagcttcttccgggcattcaaaaaagagtacggcgtttctcccaaggagtacagggagcagcaccgcctgcccgaacagcaggattacaccatataaggggatttaaccgacatgaatacacctgatatcctttcctttgacacatacacaaactgctgcctctgccccaggatgtgcagaatcgaccgcagccgcaccaccgggttctgcggctgcagccattgccttacagctgcaagggccgccctccaccactgggaagagccctgtatcagcggcggtggggattccggcggtatcccggcagcggacggaggtgcccctgtaccgggcggcggtatcccgtcccccggaggcagcggcgccgtattcttctccgggtgtaccctgggatgctgtttctgccagaaccaccgaatcagcagcggacatttcggccgtgagctgaccgctaaggaactggcccaggtattcctccggctccaggaccagggggcgtataacataaatctggtgacacccacccagtacctgccccatatcatctccgccctggaccaggtgcgctcccggcttaccatccctgtggtctataactgcggcggttatgaacgtgtggagacagtaaaggccctgaaggattatgtggacatatggcttcctgacttcaagtactatgataaccgtctggcccagagatattcccgggcaaaggactattttgagacagcggcggctgctgtccggcagatgattgaccagaccggcgccccggtttaccagtcctcccattccggactgctggcaaagggcgtcatcatccgtcacatggtcctgccgggacaccgcagcgactccattgccctgctggaatggatgagcaccaatctgcccagaggccggtatatggttagccttatgagccagtacacgccctatgtcaggaaccaggaatacccggagctgaaccgccgtatcacctcctacgaatatgacaaggtggtggatgccgctatccggctgggactcacccagggattcatgcaggaaaaaagcagcgccagggaagagtatacgcctccctttgatttagaggggctttaacccaaaaacccggaaaaaccgcagccctggccgcaaaaaaagcgcctgcccatccggctgcgccaccccgtcccaactcatccaacaaagcctctcacggccaaaaccccttcatgacttagcataaaacacatgaagacggatatcgaatctttgactaaccacgttcgcagattacgatatccgtcttctaactatttcgtccattggactaaacctcacttttccgaaacaatctttttaattatttctggctttttctatattaagttgttacaccattctacgttccgctacttcgctcctacttctgcatttcttcacttatgtctgattcatttcttttattgctttttctttactatccggtatcatctttcgttctaataatactttctcgtcatatcactaaaccgattttacattttttgatacacttgagatagtgttacaaattcaatcattcatttgtttataaatgcttcactcaacagtttgtatctttaattcatatctttaaataactgcaattgctcttaaaacattcaatctatataacttgtatttcgtttattaaatcatctatttgtgaacttacccattcacatatgaacttcattaactcatgaaaacttgctacttcttgaactgtttaccaaccgattggatgattgtttctttaaatcaatttcttaaaattacgtttctgtttgagcgtttcacttaggtagattggtttttcctggtctcatttataatttaatttcttaatattataaatgaaacaaaatttaagtctttggcggtccgtacctcctttgcttagattttattacttgtgaactgattgtctacagttccttgaaatcttttgttctctgttcttttgttgttttcattatagtaaatgcccccgcatttgtcaacacttttttaatctttttattatttttttagtttattaatattttaatccatttaattacaattgttcctattttaatacacattttaatgttttatttgtattaattatttaaatattctgattttttccaaaaaaagatacctatatctcacagatacaggcatcttttttcctattacttacttttagctgttttcatcagccacgaaacgcttccacttcttctctggacggaatggagggggctgccccgggacgtgaaaccgcaatcgcagccgcccttgccgccaggtcaagggcttccccggcatccaggccctgcaccaggcctccaatgaggaaaccggtaaaggtatccccggctgccgttgtatccgccacaggaaccttgtagataccctgtgtcaggatttgtccgccgtcccagtaaagggagccgtccccgcccagtgtcaggacgattctggccccggggaacctggatgaaagcttctgaagcagctcctcaccgctgccctgctccccgcatatatcgcctgcctcaatctcattgagcaggaaatagtccacatattccagaggataggtgctgattttatcatccataggagagggattcagtaccagcatcatgcccttttcatgggccttctccatgatatagccaatctcactgatttcattctgcagtaccaggtaatcccccctctcaaagtgggacatgacttcatccaccatgtttctggtaatccgctggttggcgccgccgtagagaaggatacagttgcctccgtcctttgctttctgaatgatggcgtggcctgtcttcccctccagctgggaaatgtactccgtatgtaccccggcttcctttagctggcggatgagaaagtctccgtccccggtgccgacggcgcctgcgtgccataccattgccccgcttttgctcaaagcaatggactggttcagtcccttaccgcctgaaaacacatgcatttcctccgaggacatagtctccccgcccctgacaaagtggtccacactataggtataatctatgttcagtgaaccgtaattaagtatcttcatgattctccttctcctttccattcatctgttttttattcttccggcaccatcttccccacatcctggggaatccgggtcaggtcccgttccacaatcatatatatcactgcatccggaggattctcctccagaagggaccggtcaaatgcctgccaatgataaaagtccacattggcaaaatacctgggcagaacgtccataagggctgtgccgaaggaatcccggattaccgctatccggcgtttatccggcgcaccgggtgtacttgtatggacgatgttcttatccccgttcacgtcccggacctggacctccaggtcttcatggtacccgcttaccagggcaatccggtcatcacagtatttctcaggcaggtggaacagattggccaggtccccgggagctcctttgatataatccacctgcacgtcctctataggcacaggtgtgcctcccaatgcctctatcagcatctggccggccgcataacccccggcgctgttccagtgggtgtccgtcttataataccacacaaaatcccggtttgtgttaaagtattccctggggtccagaaccgtcacatccgaatgttcccggatataatcctccagctgctgaggccggttcccctccctgacccgcttatacgcatccggcatatattccccgtagattccttccttgttgggagcaatcatcatgaggaatgggatgccccggctctcataatagccggccgcctttatgacctggccgccaatccaggcagcgtcatccgggtaaaagggctgggttcccagggcgtcgtaaagactcatgcccccggcaaaaaagtaccagccctcctttcccacaatcacatcctgggaatccgcatagccgaacagctttaagttaatcatggagttcatgctcaggaagagatttctaaatgccgcatggtcattgatatagctgttgaccgcagccggataagcctcgtatgtatcaggtgaaaacaccggaaactccgccaggttcctgttttccccggtgccggtctgaccgctttcctttgcaaagggaaacagcagattaggtatcagaagcagggcccagaaccctgcaatcataatctttttcatcataggtactgctcactttccgtatggactaaaatctgaagtaaataaacgcctgataggtactgctgaccatgagaagggttcccagcagcaacagcaccgccataacggccgcatcccccgctgttatgttctcctcgtcaaacagccgctccttaagacggggcgccagctgctggacaggcccgcagaataccactgccagcaccagcaggaacaggatgcggttatccgcaaaaatccgcggattccacaggcctttgcttggaatcagcattgcttttagcagtatcctgccattgtgcagggtatccacccgaaacagcatccagcccactgccacagctcccagagtgtacagatgattcaggaatttcaggggatttttttctaaaattctgccaatccacagccgttccgccacaatgagaatgccgtaatatacgccccagcatatgaaattcatgctggctccgtgccacagtcccgttgccaggaataccaggaagagattcacgcaggtacgttttagtcctcttcggtttccccccaggggtatgtacagatactgcctgaaccaggtggaaagggagatatgccaacgcctccagaactcgctgacagaggccgacagatacggataattaaagttctccctgtaggtaaagccgaacatccttcccaggccgatggccatgtctgaatacccggaaaaatcatagtaaatctggaaactgtacagtatcacggccagccataccgtggccgtgcccagctgttccaagggcaggtcaaacatccggtccaccacctggccgaacatgttggcaaacaccattttcttcaccaagccgtacacaaagcgcttgatgccgtaggcatgcatggacaggctctcctgccgctcccttatctggggctccagctcatgatactttacaatgggaccggacagaatctgtgggaacagggagatgtacagggccaggcgaaacacatttctctgggcgggattctccccccggaaggtgtccgccagataggaaatggactggaaggtataaaaggaaatgccgatgggcagcgcaatatcccttggcgcaaagccctcgcgcccaaggaccgtcatggccagttccaggaaaaagttgaagtatttaaagtaccccagaagccccaggttaaccagaatacccaggacaaatacagcctttttaagccccctcttttccccgcagccatccagggcaaggcccaacccatagttgagcagaatggacagaatcaccaggaccacataccgtggttcgccccagctgtaaaaaataaggctggctatgagcagaaccccattcttaaattttctccccggcgagatgtagtatatcagggccagggccggaaggaaaaaccaaacaaacgtaagtgaactgaacagcatattgaggaaaattccctttctatcaaagtttgtcaattatttataactaaggcgcaggctgcacaggaacagcgtcctgccttggaatcttgcgccgtatcttatggaatgtaaccatatgggcaagggctgtaatggcccaggaaacaggataggacaggtacagcacatccagggaacggtaggcggcaaacacagtaaagacccacagcaccctgaaaccgcacgcgcctgtaagggatacaaacatggggataatggaatatcccagccctctcaggcttcccaccatacagtccataatgccgcacaggaaataggtgctgcagataatttccagcctcagcatcccgtagtgcagcacctcggaatctgaggaataaatatgcagaagaccgtttccggcggccactgcggccagtcccaggactacgcctacagccgtcaccacccccaggcatatgtacatgattttattaatcctgctgtatttcctgccgcccagattctggctggtaaagctcagattggtctggtataccgcattcatggccgtatagacaaagccctcaatgttggatgaggccgtgtttcccgccatggcaatggagccaaaggagttgacagaggactgaatcagaacattggaaatggaaaatatagctccctgcatacctgccggaagtccgattttcacgattcgcttcagttttttgggatgaatccgcagctgctttaaatccagcttcagggcacccggagcgcccatcaggctcttcaggaccagaaatgcggagatatgttccgatataaccgtggcccaggcaactccgtccacgcccatccccagcacaatcacaaagaacaggttcaggcacacatttaccacgccggaggcaaagagaaaatacaggggccttctggtatccccgatggccctcagaatggctgcgccgaaattatagaccataagtaccggcattcccaggaaatatattctcatgtaaaggactgactgggccagcacatcctcaggcgtccccataaggcgcagcagcggatttgccagaaggattcccagcaccaccaggatgaggccgctcacaatgctggtggtcaccgccgtatggacagtctcgctgacatccttgtcactctgcgccccgtaataacgggccaccagcacattgacaccaactgagagtcccacgaatacattaattaataggttgatgagcgaagaggtggagcccactgccgccagcgccccgctgccggcaaagcggcccaccacaatgatatccgctgcattgaacagcagctgcagtatgcctgacagcatcaatggaatggaaaataaaaggattttgcccagaagcgggccgcttgtcatatcaatctcataggactttttcatcttctgctaactccctgtgtcattcattctttctgccaatccatggcatacgttcttatcagttatatcacagggccgtgttttttacaatgggttaaaaggccgggaaaaccttcgaattttcttgacaattccatgcccgtccattaaaatggagcaagtgataagggagtaattggcatgccccgccctgccgggcatgtaataaggtcaacatactgatagtttctatctggctttatttgaaacaatgagacttatctacagccttctcaggctgtaggtgggtctttttttataccgcaatccatatattaaaacatcaccagggaggaatcattatgtcattaactgaactgttcgttatcgctgtgggtctgtccatggacgcctttgccgtatctgtctgtaagggcctggccatgcctaaaatgaactggaagggcgcccttttagtgggtctgtacttcggcgggttccaggccgccatgccccttttcgggtatttcctgggctccagcttcagcctggccatacgtgcttacgaccactgggtagccttcatcctgctggctgtaatcggcgccaacatggtaaaggaatccttcagcaaggaggaggaatgtcctaatgcggacctggatgtgaaaaacatggtgcttctggccattgccaccagcattgatgccctggctgtcggcgtaacctttgccttcctgaatgttgatatcctccctgccgtgtcctttatcggcagcgtcaccttccttctgtccctggcaggcgtaaaggcaggcaacgcctttggatgccgctataaatccaaggcagagctggcaggcggctccatcctcatcctcatgggattcaagattctgttggagcacctggggattttgttccggtaagccgtacataagaacccggccgtccattccagggcgttctcctcatactgtattgccggcccgcacagcgccgccattttcccataaaggcggtggggcagcgtcctctcagaatacgctgccccaccgtcttttattttatcttttcctgtcctgcaatccgtccctggtctccaagcttcagccgcctcagattctgacaccgctgctgtccagctggtaaccgtcaatggtgcggtttgtctgcatcactccgttttcagggtccagataataccactggcctttgtattccagccagccggtcttcatgtagccgtccgtgctgaaaaaataccacttgtcgttaatcatggcccaggatgtaaggtactcatcctggtacaggtatctccagccgcgcacgtccttgctccacttgcccagcaggatgttgcggtagttgcccatgtcctcctcgggcagcagcatgaaataccggctttcctttttgtcctgataactgaactctaccatgtaacactggtccagataattgtaatccccttcaacggactgctctttttcaaccgtctccggccggattacagggtaatgggtcccttccttcaagccgtacaccgtacactccagatacttctgggtctcgcccctataggtgacaagataataattcagtgtcacttcattcaggtccacatcacttttgtcctttgtaactgtgaacgtatcgtattccgataccctgtaccccagcaggtaggaagaatatccatcgtaaatcgtggtccttctgctgttaacatccaaatgcagggtaacaggcacctcagccttaaatgaagctgctgcctctgagacaaatgcagccgacacactgagcactgccgccaggaccagcgcgcctaaccgcttaacagaaccataccgtctcatccggtaccctcctctcaaacctttggactactcatgatgacatccagggtgaattcccggtgcatccgtcaacccttattttaaaacaatcttcttgaagttcttcttgccgcgctttaccaccacgccgtcaccggcaaactggtccctggcataggaagccttgatatccttcacaggggttccgtccacggaaacaccgccctgttccacattccttctggcctctgaacgggatgccgccagtcctgacttgttaaggatgcttaagatatcaatggttccttctgtaaaatcctcttcggaaagctggaaggtgggcatgttctcagtgcttgcgcctgctgcaaataaggccctggctccttcctgcgccctggcagcctcttcctcgccgtgcaccagctttgtaagctcaaatgccagtatctccttggcctggttcagctggctgccttcccacttatccatctcgtcaatctgctccagaggaaggaaggtaagcatgcggaggcacttaagcacatccccgtcccccacgtttctccagtactggtaaaaatcaaagggtgatgtcttttcagggtccagccatactgcgccggactgtgtcttgcccatcttcttgccctcggagttaagaagcagggtgatggtcatggcatgggcgtccttgcccagcttacggcgtatcagttcggttccgcccagcatattgctccactggtcatcaccgccaaactgcatgttgcagccgtaccgcttaaacagctcataaaagtcatagctctgcataatcatgtagttgaactcaaggaagcttaagcccttctccatcctctgcttgtagcactcagccctcagcatgttgttgacggagaaatgcggtcccacttccctgaggaactcaatatagttaaggcccatgagccactctgcattgtttaccatcatggcctttccctctgaaaaatcgatgaaacggctcatctgcttcttaaagcagtcacagttatgctggatgatttcaggagtcatcatggtacgcatgtcagaacgtccggacgggtcgccaatcatgcctgtgcctccgccaatcagggcaatgggcttgttgcctgccatctgaaggcgcttcatcagacaaagggccatgaagtgtcctacatggaggctgtcggctgtggggtcgaagccgatatagaacacggcctttccctcgttgaccattttcttaatttcttcttcgttggtcacctgggcaatgaggcctctggcaaccagttcttcgtaaatctgcatggtgtttctctcctcttcttactttatttattttaccatacttctgctttcatgcaagggcttgattcttacgttttttatacagggaaggcaggggggcgccagggcgccgcgggcccggagttccctttgtgaactaaaaaaagccccgcccttttccaaaaggacgaagcccgcaagccccgtgttaccacctgatgttcacagacagctcgcgctgcctgcctcttcgagtactggtgaaagccggaatcacacatgggaaccgccttgcctcttccctgcgccggcatcccgctgaatccacactctcatatactctagcacgataacggatgcaggacccgtcgcagcctactgggcctgttgtctgcagcagcgccgttgggtgcgaagctcagggatgtattcatggcctgcatcacatgcgcctctcatcccccggctgctttctgtctgttcctgcaggctactacttgttcccgtcgtagccaattcatgaaattatgaccattatagacagactctcctgttttgtcaagagtcaatcccgtcctctgctgttttcccctccggacgggttactgttcagaggtatcataaatcagtatcggcaaagtgacgaaatttaaaatttaagaaatagcgtattttgtggctatgtctagcttccagtctacaccatgggttctttctttacaagttagcctctgaacagtaaccttttgcatggcgcttttatcaggctgcagggattttaggaggatattgctgcatctgtattgcatcgccaggtaatatctggtataatgaaaaacagttgaatgtgaacgcgataacattaaaggggacatttgtcccccatataagtatgaaggaggtatttcagatgaatattcttagcactgacaaggcgccgggcgccattggaccttattcccagggatacgaggtaaatggggtaatttatacgtcaggacagattcctgtgaatccggcggacggaaccgttgcagagggaatcgctgctcaggccgagcagagctgcaagaacgtgggggcaatcctggaagcagccggcagcggttttgacaaggtgttcaaaaccacttgtttcctggctgatatgaatgattttggaacgtttaatgaggtgtatgcaaagtattttatgtccaagccagccagaagctgcgtggcagtcaagacacttccaaagggtgtgctctgcgagattgaggcaattgctgtaaaataagtgatgaggaaagccgggaggttccgggtttctgtaatatcttaaatgaattgtgtaaggccgccggatgttttccggcggccttaatgctgtcagttatctgattttttatctgttatgcaatggcacggaagttggtactgtcacccaggcggacgacggtaagggatgcatcctcaaaggagaatcctgcgtcgctggccacaacctccagggttcctgcgccggttaccgggaacggtgcattgaaggaaagggttacctcctcattggaagcagtgaaggtgtggcgtgcaattgctccggttatgggagttccgttcagcgtaagctggactgtaagcgtggagggtatggtggttcctgcatcaatcagggctgtgccggtaaagaacgcctgatagataccgggctgggtaatctgcacgtcgggagaaccggccgtatgggtaatggaagtgccggataccagtggggtttcagtgaaaatcagggcgccgttagccgaagtgggctgtgtggtggtgtccacggttgccagaacttccggtgctcctcctcctccgggttccccgcggggaatgacgaaattaaagactgcgtcttctgcggtaccggaattggttacggatgcttctgtgccagggtcgcctgtagtaacggttcctattgtgatggttgcagcggcgccggtaggccctgtttcaccggttggtccggtaggcccttctgttccggtggccccggttgcgcctgtttcaccgtcagcgcctgtggcgccggcaggtccctccggccccgtggccccagcagccccgtccgcgcctgtcggtccggcagggccttctattcctgtggctccggtaggtccggtgtttccggtaggcccggtggctccggttggtccggttggcccagtcgggccagtggcccctgtggcgccggtagtgccttgggagcctgcggggccggttgccccacggggtatggtaaaatcaagcacatgattgggtccgccggttacatctgtgacgctggcagcagtaccgggttcacctgtggtggtattgcggatggttatggttggggattctccggtggctccggttgcgccagtggccccggtagctcctgtggcgccagtagctccagttgcgccagtggcccctgccggtccaatgggtccggttgccccggtagtgccggtgggtccctgtggtccggcagcgcccgtagcgccggttgccccgttcgtccctgcagttcctgtggccccagtggcgccgacaggtccttgcggcccggttggtccggtgggcccggtgggtccagtgattccctgggagccggaggcgcctgcaggtccggtagctccagttgcgccggtagcgccggtagctccgcgcggaagatagaaatccagaatatggtcgggggaaccggttatgtctacaactacggccggagaaccgggttcgcttgtagtggtgttgcggatggtgatggtttcagaggcgccggtggggccggtgggtccctgcggtccggtgggcccgggtatgccctgggctccctgtggtccggtaggtccggcagtgccggttgccccggttatgcccggaattccttgcggtccagtgggtcctatgggcccggtggggcctacataaccctgaggtcccatggctccggtgggcccggtagggccaggtactccggggcagcctctgggccccattggtccctgaggtccttgaggccccataggtcctgtgggcccggtctgcgggcagcagctggggggctggcatgggctgcatgggccgcaccagcatctgtccctgtgtccgccgcagttatccgggcggaagcctgtttggggtggtgcacagctggattgctgcggatttatattatctggataatcataatacataatggtctctccttatgattttgatggatatacaggtccggcattatgccagccggatgacgacaagtgaggctcctgtgccggcctgaaggacagcagtgcccagcagaccaaagagctgaagctccagtgtatctcctgcggtaagggtgttgattcgtgttgctgagaattggccggtagcaactgccggagcatcgatggtacctgccatgggtgcattattcaaaagaacacgcgaggacatgagcagggcggctgttgtcttaatggtataggtgataaggtaagtgccggttaccggcaccgtaaatatggtattggcagcatttacagtgaaacggttgagtatctggtcatttgggagcgggaccgctgttccgcctacaataacagcgatggcggctgcagctgtattctgggcgttcatgttgtcagcagtgacagcgagccctgtggcccctgtggcaccagtgacgccggtagctccggtagcgcctgtggctccggtagccccagttgcccctgtaggcccggtggctccggtagggccctgaattccggcagttccggcagccccggtagctccggtagccccagttgctccggtagccccggtggctcctgttgttccggcaggcccctgaatgccggcagcacccgtggctccggcaggtcccattggtccggtaggcccggttacgccggcgggtccctgaacgcctgcagcgcccgcagctccggtaggtccagaaggtcccatgggcccggtcatgccggtaggcccggttacgccggccagtccctgaggtcctgtggctccagtgctgccctgaggtcctgtggctccagtgctgccctgaggtccctggggcccctgactgccctgaatgccctgcggtccggcaggtcctgtggctccctgaggcccttgaggtccctggcttccggcagcacctgtatttccagctgttccctgaggtcccggaattccctgaggcccccgggggccttgggcgcctgtatcaccggtaaaacctctgggtcccattggccctgtgggccctgtggggcctacatagccctgaggtcccattgctccggtcggtccggcaggtccctgtgctcctgggcagcctctgggtcccattggtccctgtgctccggttggtccggcaggtccctggggacctctgggtccgggacagccgcctgggaagcaactgcccgggaagcccccgccgggattgccgcagccaggattacagctgccgggattgccgcccggaaagccccctcctggattgccgcagccggaagtatttacgccggaaaagccgttgtttcccggccagccattgtcgtctgctgctatattactgtccgggcagccgtcgtcaaccggaaacacatcgtcttccgggcatcttccctgacccgggaaaccattgcccccggggcagcctccattacccggaaaaccgttgtttctggggcacccacatggtctgcgttgttccatattatcatttcgattcattccgtttggaaaattaaaatacataataacctctccttattttattgtgcggaaggctgcccctccgccggctgtttcagtatgtgctcaaagtaggtctggttctgcctgacagaagggtgctcaggcttaagcttttgtgatttcaggtgataatgccatgccctgcggtggtctcccaggcggtcgtagcacacgcacagctggatggcgggcaggaaaccataacagtctttttgtataaaggcgcctgtctgttccggcggctgcgacgacaatgcctgcgtataccaataagcagcctccttgtattttccttccgtcattttcatccgtcccagttcacagcaggcttcaccccggggcctgtcatacaggaagcttttaaaaagtgcctccatggcttcttccgcattttcaagctgctcctcacacagtgccagatggaggcaggcatctattttgttttccgtccagccctccggttccaggagaaatgccctgaaagctcgtaccgcatcttcatagcgcctatgataatacagctccctggcataatagaactggtgcctgggttccagaagttccccttccttcagcatggtttcgtatatccgcaggttgcggtccttatctccggcgccttccttccggtgctgaatctcgatatcagtgtagaggatgctgccggaaggggacactgcctcatggacccggccctgccactggaagcccttgcggttctttaagaggcgttccctgtaataggaaaaggaggtccttccgtttgcgtcaaaaccagtgagatatttcatcatcaccacatccacagaggggtccagggtttccttcagtttctttaaacgggcagcgtgttccggttccatcacatcgtcagcatccatccacatccagtagtccatcaccgccttacggcaggcagcgtttctggcagcggcaaaatcatccttccatgggaaatcgtagacttcatccgtgtaacgggcagcgatttcttttgtccggtccgtggagccggtatccatgattactatctggtcggccacctcggacatggtcttaaggagccgttccagcacggcctcctcattctttactatcatacaaagactaatggttatcaaaagcaatccccctgtatctgtttctttataggccggatgtccattcacatccccggcatactatactatatgaaaatggaacaagtttggtgtgcaggaggatggcagaagactgtgatatgtgctataatagggaaacagacaaaagcgggaaggaggaggttcaaatgagaaaaagaggggcatgtgccgtgctggcaggggcagctctgattatgacctgcgcactgtcctttacagcctttgcaaaggaggaaaggaccccggtggggaaaatcaagctgaatttcacatcagatatccaggcaggagaaatcggaggcagcgtggacgtgacactggaggatggggagtgttccattgagagcgtggatattattaacgagggcgataactgggtaggcggggataagcctaaggttgagatatggctttccgctgacagtgattactactttaagaaatcaggaaagagcgcattttcattttccggcgatacggtcaagtatgtatccagctccaccaagagcgacaaggaagaaatggttctggtggtaaggctggataagctggatgaggatgatgaggacctggatgtaagcggcctgttgtgggatgaagacaatggggtggctcactgggaccatatgagcctggcgaagaattacaaggtccgtctgtgccgcagaggcggcaattcctatgaggacggcattggcgccacctatacggtaaaggaaaacagctatgatttttccggcaagtttccaaaggcaggcacttactattttaaggtaagggccatggattccaggaataatgccggagactggcaggaatcgccttatatcgagataacagaagaagatttggccagggtgaacggccagtggctcagggatgaccggggctggtggtaccagaaaggtgacggcacctacacggcaaacggatggcagtacattaattataagtggtatttttttgaccaggacggatatatgaagaccggctggatatcctggggtgataagctctattactgtgacccgtcgggagccatgctggtatccgctgttacgcctgatggatttaccgtgggtgcggacggggccaggacgaattaaaagtgcaaagactttccatacataaaatgttaaaaaatggctatccttatatcaatgataagattgatatgaggaggtcatttttttatggtaaacgaattggagatagaggctgtaaccggcagggagatactggattccagggggaatcccacggtggaagtggaagtgtgcctgacaggaggagctgcaggcagggctgctgtcccctccggggcttccaccggtaaatttgaggcagtggagcttcgggacggcggggaccggtacaacggactgggagtacggaaagccgtggaacatgtgaatacagtgctcagcgaggcagtgctctttgaaagcgctctggaccagcggcgcatagaccgtctgcttctggatgcggacggtacggagaacaagggaaagatgggggccaatgccatactgggcgtgtccatggcagtggccagggccgcagccaatgagcttaggatgcctctctacaggtatctgggcggaatccatgcatccactcttcccattcccatgatgaatattctcaacggaggaaaacacgctgacaacacagtggatttgcaggaattcatgattatgccctacggggcctgctgctttgcggagcgtctgaggatgtgcgcagaggtctatcacacattaaagaagcttctgaaggaagaagggtacagcaccggagtaggagatgaaggaggctttgcgccggaccttaaggactccgaggcggtccttgaatttctggtaagggccatggaaaagagcgggctgaagccgggcacggacatgaagattgccattgacgctgcgtccagcgagctctacgacgaagccagcggcatgtacctgtttccgggggaaagccgtatggcgggaaaggaaatccgccgcagcgcacaggagatggtggattactacagacgccttgtggatgcgtttcccatttgctccattgaggacggactccaggaggaggactgggtgggctggaaaatgcttaccagggagctgggtgaccgcatccagctggtaggggatgacctgtttgtcaccaatacaaagcggctgtcaaagggcattgagctgggagcaggaaatgccatcctggtgaaggtaaatcagataggtacgctgacagagagctttgaggccattgagatggctaagagggctggtttcggcaccatcatatcccaccgctccggcgagacagaggattccatcattgcggatattgcagttgcagtcaatgcagggcagattaagaccggcgctccctgccgttctgaccgcgtggccaaatacaaccagctgctgcgcattgaggaaaacctggaaggctgattgcacctgaggaaaagcggggaggctggtacggacaaaaattcccgctggtgaaaggcagaggggagggaatgtatccgggcgctgttttgcccggaaaatcccctccctgtcccatttaattcttgacaaccggaaaaagcagggtatgatgtaagaagatgcattgattgcatcaaaaggggaaaaataaggagagagacatgagagaattactgtttatggaacctgtttttaaggaagccatctggggcggcacccgtcttaaggacgtgttcggttatgatatccccagcagcagcacaggcgagtgctgggccataagcgcccataagaacggggattgccgtattgccggcgggacatggaaaggacagagcttaagctccctgtgggagagccaccctgagtggtttggggctgcggcaggctgtcataaggaatttccgctgctggttaaaatcattgacgccaaaagcgatttaagcatacaggtccatccggacaatgcctatgctgcggagcatgaaaacggctccctgggtaagactgaatgctggtatatcctggactgcgacccggatgcaaccattgtgattggacaccatgcaggaaacaggaatgaagttaagcagatgattgaggagaagcgctggaaggattttatacgggaaatacctgtcaggaagggcgactttttccagattaatcccggatgcgtccacgccataaagggcggcaccctggtgctggagacgcagcagagcagcgatattacataccgcgtctatgactacgacaggctgtccggcggaaaacccaggcagctccatgtaaaggaaagcattgatgtgatagaagcgccttttaaggaggacccggacgccaaaccggcagttgtgaaggaaacggacagcggtaaaaaagtacatcttgtaacctgtgcttactatactgcagataagatagacataacaggccgctggacggagaattacggggacagctttgcaaatgtgagtatcctggacggagagggaagcgtcaacggtatcccggtttcaaaggggcagcattttattgtccccgcgggatttggggatgtgattttcgagggaaccctttccctcatttgttcccaggcagtctgaacccggttggcgcaatgggctgcgcggcgtcttacctataaaaatatgggaaaacaggttgtgttttaggacaaagtatgataaaatacctttgtttgactataagaaaatggagaggtgcaggcggatgtcagtaatacacgttattttgtcaatcatatatgtaattcttggtgttgcaatatcagtggttatcctgatgcaggaaggtaagtccaacggactggggagcgcaattggcggtatctccacagacagttactggagtaagaacagaggccgttccatggaaggtgcgctggagcactttaccaggtatggagccattgcattcatgctcattaccattgccctgaacgtgcttcttaaggtcctggggtaattaagataacagaaggataagtgacaaaaacacccttgtattcatataagggtgttttatttcattcaggcggattttggcctgtttcaggacaggccggatatttttaagaaagaggtcatatggaaaaagaaatattggaacagcggggaaagatgctggaggaagtgatgagtgacaagtcctatgtgccaatgaaggcaaaggagctggccatgcttctggggattcccaaatcacagagagatgaactgacccaggtactggattatctggtgtcagagggaagaatcggaatttccaagaaggggaaatatggaaaaccggaggtgttttccattaacggcatattttccggacatcccaagggctttggctttgtggctgtggaaggcatggagcaggatgtgttcatccctgaggacaggacaggcgcggcccttcacggggacaaagtccagattgtggtggaatcccagggaccgggaaacggacgcagggctgaaggctctgtgcttaaagtgctggagcatgccaacaaagaggtggttgggtattaccagaagagcaagggctttggatttgtgattccggataaccagaagatttccaaggatattttcattccccagggctgcgatatgggagctgtcaccggacataaggtggtggcccggattaaagatttcggggatgcatctcataagcctgagggcgttgtgaccgagattctgggccatgtcaatgacccgggaacagacatcctttccattgtcagggcctatggactgccggaggagtttccgccggaggtcatggacgaggtggagggctgcccggatgaagtggcggtgcctggcccttccggggacgagaagacctgggacggaccttacggcattggggatttgacttcaccccaagactggaccggcgatttggcgggccgtctggatttaaggggactgcgcacagtcaccatagacggagaggacgccaaagacctggacgatgcagtgaccctgtgcagaggcagacagggcgggtatatcctgggagtccacattgcggatgtaagccattatgtaaaggaaggccgcccgctggacaaggaggcgttaaaaaggggtaccagcgtctatctggtggaccgggtgattcccatgcttccccataagctgtccaatggaatctgttccctcaatgcaggaacggaccgcctggctttaagctgcatcatggaactggatgaacaggggaatgtgctggaccacaaaattgcggaaaccgtgattcacgtggaccggcggatgacttatacggcagtgaatgccgttgtcacggatgaggacgaggcggtcatggctgaatatgagggatttgtgcccatgttcaggctgatgaaggaggtatccgatatcctcagggaaaagaggagaaaaaggggggccattgattttgatttcccggagagcaaaattcttctggatgcccagggaaagccgctggaaatcaagccctatgagcgcaacgccgccacaaaaatcatcgaggatttcatgctggcagccaatgagacagtggcagaggattatttctggcagtctcttccattcctctaccggacccatgataatccggacccggagaaaatgaagcagctggggacctttatccataattttggatatttcatccggcttcagcagggggagattcatcccaaggaactgcagaagcttctggacaagatagagggcacgcctgaggaggtgcttctctccaggctgaccctgcgttccatgaaacaggcaaagtataccaccctgtgctccggccattttggcctggctgccaggtactatacacattttacttcgcctatccgaagatatccggacctacagattcaccgcattattaaggaaagcctgaagggcgggctgggggataagcgggccagccattatgaggccattctgccgggcgttgccatgcagacgtcagctctggagcgccgggcggaggaagcggagcgggagacggacaagcttaagaaatgcgagtatatgtccgggtttatcggtcaggagtttgacggcgttatatcaggcgtcaccaactggggcctgtatgtggagctgcccaacacggtggaagggctggtgcgcataagcgagctgcgggatgattattatatatttgatgaacagcattacgaactggtgggagagatgaccaggaaaacatttaagctgggccagcccatacgggtccaggtggcgtccacggaccgtctgctccggacagtggactttatcctgtccagggactgggatataagcccgggcaagggtgcttccgtgtaaggctgtaagtcatacaggcaatcatgactagaaagaaagggaaataccatggggaaggaaagtattaaactggttgcgaacaataagaaggcataccatgattatttcattgacgagaaatacgaggctggaatcgagctctttggcacagaggtaaaatccatccggatggggaaatgcagcgtaaaggaagcctttgtgaagattgacagaggcgaggtgtatgtgtgcggtatgcacatcagcccttatgagaagggaaacatattcaataaggacccgctgcgcgtcagaaggctgctgctgcataaatacgaaatcatgaagctgaacggtaagattgcggaaaagggctataccctggttcctctccaggtgtacttcaagggcagcctggtaaaggtggaggtgggcctggcccgcggtaagaagctctatgacaaacgggcagacattgccaagaaggaccagagaagggaactggagaaggaattcaaggtgaaaaacctatattaaggattggaatgagaaggtgctatgagaagctgcggcgagggatgtttcgagggaaaggcatatacggatttcataaaggaggctgagggacttaagtccactttgcgcacagcctggacagcagaggggcggcaggagagcacagcagagcattcctggcgtctggctctgtttgccggggtgctgtgcagggaattcccggaactggaccgggaaaaggtgctgatgatgtgccttgtccatgacctgggggaacggtacagcggagatatatcagctgtactgaggccggatgcagaagataagctgaaccaggaacgggccgatgtacagcgcatatgcaggttcctgccggaaggaggagccggggacgaggtggccgggctgtgggaggaatacagccggggcattaccccggaagccaggtttgtaaaggcccttgataaagcggaaaccatcatccagcacagccagggaagaaatccggccggatttgattatggattcaatctgaactacggaacggaatactttgaccgggaccagcgtctggaaaccctgcgcggactggttgatgcggaaacacggaaacggatggaaacagagggaaaacaaaacaacggttgtgcgaaggacagatagcaaaacacaacaaaaaaacaagcagttcattctgcttgttttttcatgacctgaccgggaatcgaacccgggtttacgccgtgagagggcgtcgtcttagccgcttgaccatcaggccttgtctgcatatctcagcgacagcttgtttatcataccatatagtttttagtttgtccagtacttttttgaaaaaaattaaactatttctgaatattcgtggattgtggaaaaacaaaaagcaagcagtaaaaatctgcttgctttcatgacctgaccgggaatcgaacccgggtttacgccgtgagagggcgtcgtcttagccgcttgaccatcaggccttatctgtgcatctcagcgacagcttgtttataatatcatatagttcttagtttgtccagtattttttgaaaaaaattataccgggcaaacatatgccggaaaataaaaatcagcaaagtaaaatgaccagtcggggaactggtcattttaggagaaggtatttcgtttcttatggggtgtaacaaaaactatataatgtattgggggggtttacgttaattataatagcatatgccatgaaaaaagtgtgcacaaagtttgaagaatggaaaaaagtattttatgcattcttacaaggctcttgtgaaaatgaaataaaaaggctctttacaggctgccggacatagcactatgaacacagcacgataacccggttgggagctgtctgtggcggtatgctcttagtggcagccgcataatataccagcaggaaatgatttgccgggaaacagaaatagggctgaccgtttagggttgacaatacagtggactgatacaggttcagcttcagcgattggtcggatgcagtgagggtttcatcaaaccaggaaaggtttacatcctcctccggcctgacaacggcaattaattcagcctggtattgcggcggatagataaggggaacaggcagggtgctgtcataaaatgcagccacacgcatgcccggcatcagccgcatggtgtccaccacaaaggtttcattggataaaatcatattgacgggctggccttccacacccagtgttatgacctgggtacagcagtccccttcctgagtagagatgttggtaatgactccgactatgggagtcagattttcatagttcataaaaaatatccttttttaattatcatatgccgggaacgtaaaaagaatccagaaagttgaataaaaaggaggaggccggaaggacttcatccctccggccgagtattatgaaaaaaagttttattagcattagctctttacataaattagtatatccataaaatgtgaggaaaattttatgattctgtaacggaattatgaacattatgtgagaagtttgtgaatgaccggacaggggaaggacagcgttatatgtaattatatggaatcatatggaatccgaagctgctatgttattgttaattttccgccattgtattgtaataaggctaaattgtgatagactggatttagacaatacatagaaggaggtataatatgaaattttatatttgcaatcactgcggcaacataattgcctatgtgaagagcagcggcgtaccggttgtctgttgtggggaaaagatgcaggagctggttccaaacaccacagacgcggcagttgaaaagcatgtgcctgtcatccgcacagatggggccaaggtgactgtcacagtcgggtcagccgagcatcctatgattccggaacactacatccagtggattgctctggctaccaggcaggggaaccagagaaaagaactgcagccaggacagaagccccaggcagagttcatgctctgtgagggagatgcggttgaggctgtatacgcatattgcaacctgcatggtttatggaaggcagagccgtaatctgcccggcatgatatccgggtgaggtgtatccggctttataagatgcagcaggatatgatatgcaatcagacataatcaaaggaaacaaacagcatttcggccgttggggtacgaaatgctgttttttagttgcaaaacagtgtggcaggataattagcaggatttttttattggatgcaacttttatgaaagctctcccgtctaatcatatgaaaccgtatggaatatgaaagaattaagatgaaaaggagatttaccatgaaaaaacatttagctgctgttaccatctgtaccctggctctgaccaatgccattcctgccgtgcctgtttacgctgccgccggaaaaccggctgccgcttattccgcgaggcagaggcgtgagggacagaaaaaagttaaggatgcggcatccagggtcaaatcagcttttaagaaacaggacctgaatgcattggcagatttatgcaactatccgctcaccatatcatacgcatccggcgaattggttgagatcaaaaacaagcaggagctgctggccctgggttccggtcctgtttttacggctggaatgaagtccgccattgcatccacggatgtctccaagctgaaagaggtaggggatgcaggggtgcagatgggcggcgatgcaggtctgagtctgtataagtttggaaagcaatggaaggttaacaacatttacagtgattacggcagccagtcaggcagcgcctcaggggcgctcaatatcggcaatctggaggaagcagccaccacggtccagaaatgcttttcttataaggatatagagactctttccaggatttgcaattatccggtgaatgtaatctatgcagatggaacatccgcagaatatagcgatgcagccacttttatagccaaatgcggcgacaggctgtttacggaccgtctgtgcaattccgtcactgccacggatgcatcccggcttcaggcagtaggcaacgccggagcacagctgggagcggattccgggctggccatgtaccagtttggaggttcctggaaggtgaataatatctatcagtaaagtttccggaagtttctggctggatagtccggccccctgccgccgttaccacagaatctgaccgcggcagaggaagtcaggaaatccaatgtatccctggaaaatagcggaacaatgccctggccgtgatatcctcttccgggacaaaggggtctggccattcccgggcgtcactggaatggttccggttatctcccagcatcagataacagccttccggcacttcgaagtggtagtcctctgattccatgggctccggcagatagggttcattcaagggtgtttccgattggttgatgtatatttggttatcccggatatccacggtctctccgggcagcccaataatccgtttgaccagcctggtcttgtccctgccgggttccgccttatggttgaagaggacgatatcccctctttggggttgggcgccgaacgcgtatgaaagtctggagccgatgattcggtcccctgtcatgatggtattttccatggaaccggatggtatatagctgttggcaatgacaaaggtgttgaggacaaaggcaatggcaatggcggccagcagtatcctgacccattccagcaactctttttttaggccggagctcccggatgatttattattaagtgatttgttcatgaaattctcctttaggatgcaaattgaatttggaaaagaacgtatgctgtgtatcagtttagcatttacaacttataaagtctttattatttgttaatatgtaagaataattaatagtttatttattaaaaaattcttcccgtgatgttattctatgaataagaatgaagcaagggagtggaatatgaaacgaatcatacgtacaataagcatcatactggctattctgttagccgcagccggcggctactatgggggaagaaggagcgtcagacccatggttggaatcacattttacgctgtcatagaagagataagggagaaccgtatcctggttcagggattggagataaatgatatcaacgggcggggcgcctttgagctgaccgtgggggataaaacagaatttatttggagaggggtgcccattacagcggaagatttgaaggttggaaataccatatcagtcacatacacaggggaagtgctggagtcgtatccggcccaggtcagggatgtgctccggattcagttgctggacgatgagacaccctactaggtaatgcctgacggacaaagtaaaatgaccagtcggggaactggtcattttaggagaaggtatttcgttttttatggggtgtagcaaaaactatataatgtaatggggggttacgtctattatagtatcacctgatgcggaaaaagtgtgcacaaacttttttagggataaaagtttgttttgtatactttttttagaagtaatcatgtttcacatctgatgggggacaatgggcctccgggttgggcagtatgttgcgggaggaggatgaaaacgctgttccggtaccgtgtttcgatgtaagaggatatgatatgcatgaaaggagatttatatgagtgaaaaaagattttccataccagtcatgttagctgccgttatattgacggctttcttcactgcaattgcctcccgatggtattttatcaatcagaaggcagacggatacaaatcacagcttacggtatgtgtcccctcatactgaatggagggatttatttgcattggaagaaagccagaacatacccgatgtattggcaattgccaggcttgaggacggcgagtccggaaaacccattgattttttcgaccccagccttacggcaactccataagataggctaaggggcttaataactgaataagataattcaggctggagcgtgcattgtattggattctccggcctttttatgtatactattttgtatttttccaaattttcataaaatcctattttgttacctggttgtaaccaaaatttgatagactggaaccagttggtaattcacttagtccgttaatatgggctatggaggtaatgagaggagtgactgtatgagcagcaaaaaaaggtttggtataagaaagaaaaaattatatgatttacagaaacgttggattgcaattttgctggcggcagctatggtactaaccaatgcaggtgctgggatgactactgtttatgcagcagattcagcagatactgttgtatttacaatggacggtattcagttgctggagtcaatccaagaatccattgccagcaacaacgaagtgacaattggtgaccttgattttacaaatggtaaagttacggactttgaacgtctgttttttggagaaggaaaactaatggaagtattcccggaaccagaaggcggaagtgtggacgcggagttaagagtgttcatacgattgccggaagatgccgatgatatgtatatggtaactggtgatgaagagattattttcttatatgtgaataacggggacgataccattagctgtaccacgaatatcataaagatggatgacggagaagagaaggtcaaaaaaaccaaacggattaacgttaaaaactttgatgcagcatatggggatgaagaggtaaattatatttcaaagccagttgaagagactgcggaattcataccggacgatggaaaaggaacagataataaggaaaccgcggcaccggaaacattggctccaacggaagaagggactattgaggaagcaacctcggttaacccggacaaggatgatgcagccaatgattctacagaagtatcaatagaaacttctgtagaaaaccagaaggatgctgaggatacagagaaggaaaaaacagagacagcagagacggagaaagaagcagagacagagcaggaagcccagccggagaaagaaacggagcaggaagcccagccggaaaaggcagcagagccggagcaggaagtccagccggaaaatacagcagagcccgatagaggagccgatggccaggtggcatctattatccgtcattacgcgccggtggttggtgacatggaagacagggatgttccggaactgccgaaggcagaatcagtaagagaaccggagacagagcctgcaatagataaggaaacagaatctgttgacaaaatagaagaaaccgcagataaagcagaggaaccggttatcaaggaagaaactggacatacaacagaagaaacaacaaatgggacaccggatgagacaccggcagtccaggatgaaactacagatgaagccgctgataccacagaagaaacaacggcggttcctgaagaaagtggcggcagtgaaacggaagaagaaattaccagggaaacagaagcaccggaaaaactgccggtcgcatcgccatccaatggcactgaaaatgagataaaaaatgatgcaggaaaaacaggttccagtggtttggtaggcattggaaactgcgctacggcaaaagcatatattacaacgctcagtaaactgaatattatggaagaaagagtaatggtttccacgacggcagacgacggagctgttatagcggtatctggttctgaaaaggctatgaagaatattgtggatgtcaaagcggaagccatgagcgatatagacagctttgtggaaaggctaaacactgaattggccggcaacggtgaaaaggttgaccgaattgctgtgtatgatgtaactgtaatagataacgatggaaatgaaacgcagccaaatgccgaggttaaaatttctattgaagcgcctgagatagtagacaatgaaagcgaggtcagtgcattccacgtaaaagaatttaaagagggcagccaggaatatgagattgagataaaggatgcggttgtaaacgagtcacagggaatggtcgtgatggggacggacagcttctctcctgtaggcgctttctctgtggtgccggctgcagatacaggctctgcctataaatcatgggaagacggcagctggaagaccgaaccgattatacttgggcccacatcagacggaattgatttctcctatgaaatattaaattcaaattataagaactttgaggcagtcatagaggtcactataggggaagatgtggatgccgatgaactgaatattaatctagatgattacattatggaagaaatcatacctaatatagatgattacatgtggaatcagacacagggcggtgataagtaccaatttaatgtaaaaatcataaataagtcccaggttgattatcagtataaagataacagctttgtttatacgattctcaataatggtgagaacactggcttctattcatatactggtcaggccattccaaaaggtactgtgatatggaatatggggaatacggccatggcatctctgtttaactgtatggtagacagggttccttcctacagcaaatggaacctgaatgaattccgttttacggattcaaaaggaatgacccatgattataatggaactggtgatttggttcagtattaccttgacttttacaatgacaggtatgatttgcaggcaaaacagcttgaccagtttccggattatgtcatagctgagattataggattcaatccgaatcctaactgggatacagggtttcagggccagacattgggtggacgcgcatcggattttgaattagctgaagcggcatataactttttctataattcatgtctgcggttatttgtcaatacagacagctataacagggacggattggaccagtattataaagacagcgtggattctgcaacctattctcttggaagccatatgcgcagctacaatgagaatggcacaacggttatggagccatacttttcaagtgcattttccaccattaaatccgggtcttccaatgcactggagaataatatagtcatggctttggatggcgactatacgactgatgcatatcaggtcagcttttttggatttacatttggtttccaattgcaaaaaccagcgccggcaacaggaaccgttctatttaatggtgagaaagtattatccggccgtgagtttacggcggaggatgaatttaccttttccttgaaaaagaatggttctgaggttgacagaattaccattaagccgttagaaagcgccaggtttagattgacggataaccttgcagcggacgaattgggaacacaagcagtgtactctatctcagaagtgggcggcggtaccacggtcaaagaggtttcttacgataatacggtttaccaggggacgtatgatattactctggatgaatcaaataacagattgattgccgtgcatgttggcggaagtaatctggaccagggagtggtttttacaaatgtttacagccataattccacgccggacacccctgggggaggcggaagcagcggcggcggaggcggcggcaactcaggcggtcaccgtaccactccggaaaccggcggcccgggaataaccattaatccggaggaagtgccgctggcatcccttccagatacacctgttttcattgacgaagaagaagtgccgctggctccattgccgaaaaccggtcagggttctgcggtaaccacatttaccatgttgttgtctggtttgctcctggttctgacagctttaggtaagaaaagaaaagaagaatcggtctgatgtcttggcaaaggcggtggagtaggtggtttcaagccaggagcggtactaagtgcgtaaagaaatgtctgtaaatgcgaatcttttaagataataactgggctgaaagttcctttttgggctttcagcccttgctttatatataacaccaactacagttgcatgttaagggacaatagacgggctttcctttgccagctccatcatattatctgtaatacgctccatcaaagtatagcgttcaaattcggcaaccactgcaaataaatgacctaaaagaaatatttccgacgtggaaataatattgaaaacttcagacctaaattgaggttcatgattgcatatgatatactgagcgtaacatgtgtaatggattttgctgcaacaaaagagagaagatatgccttacgtttgggtgcacaatagacgatattatggaaatcacaccaagcatagaagatagatgaaatttttattgagctgtaacgacataaatttcaggagatacaaggaatggaattaggatggattgatttttcaaaaacagagtgaagtaaagtttttgattatgtgaaatccactccatatcttatgtcatttatgcgtgattatcagttaaaacgctatattgaaaaatactttgcttaacatcctgatgaaatcaacaaagttaataaagatactttttggcttaagagaagaacacttgaccgatatgataaagtatcgaataacaatgcccggcttgaaagagttatgtcacatatatttaaagataatgcagagcttcttttgtgggttcctccggcacgtccgtattatcagccgcagggtgtatttaatgggggacccttaaaggcccctcatttattaactttttgttagatttcatattgtggttcgtgttgtgccttatcataaaaacgcacatttttcattagatttgcaacataatatatgtgattaaataaatgaaaaaagtacgtatttacgttgttttccgcaaatacgtacttctcaaaaaatggagctgaggggaatcgaacccctgtccgaaaatcaattccctgttcttctactatcatagtcctttatttgacattccctctgccatcagagaaaggacacccggatggtttcagtagcttcatgatacgcccatatgctcaaagctttgcatacgtcgtttcccacatagtcgatgccagggtcttaaagtgcgggtgctctaagtctgacagctgccattaggcagcgattgctaattcgtcgttagcgtttatatttatttttgccatttaacccatcgcatggggatagcttcaccagctgcatgacccccgtcgaaaccagtacaacccctgaatactcagtgctgcgcttacctggtatgctaacgaaatcctgcgctcactctatattagcagtttccggcgccgctgtcaagggcagtgatgaaatatgatagatatggacagtctggataacaatggctgcctcaggacagatatggccggagctccggatggggccggacataaattcgtataaactttgtaatgaaacatacccctataattaagagaaaagaaataccagaatcccctctttctggtaatataaggatagggcatatttgtatgctccgcatcatatgaatagattccggtgataacggaaaagagggaggcaatcatgaaacataatatgaagaagacagtatacgcagcaggactcagtgcggcagtggcggccgcagccttagggcttggcggctgtgcggccgggacacagattccggacaccctgaaggtgcagaatattggcgcggcggagaatgtaattacagtaacaggccgcgaggaggtaaaggtggtgccggatatggcacagattgagtacgctgtctataccagggaagatacggctgctgcatgccaggagaagaacgcccaggacctgaacgcagccattgagacattgaagggacttggggttgaggagacttccatacagacatcctcctatggtctgagccccatccgtaactggaattccgatagacaggagataaccggctatgagatgaccaccagcctgactgtgtccgacattcccattgacaatgcaggtaccattatcacaaaatcagtggcagcaggcgtcaatggcattaattccgtcagctatttttccagcagctatgatgccagctaccaggaggcgctgaagggagccatggctgttgcccaggccaaagcacaggccctggcagaggccagcgggaagacactggcaggcgtggttcacgcagaggaatttggctatcggccggagacacgatatgcctcctataattcaggcggctctgccaaaatggcggcggcagtggaagatgcagctgctcctgttatgccgggccaggtcagcgtggaagcccaggtaacggtttcctatgagctgaacgaatagattatattgaatctgccggatgaaaaataaataaagtgttgcagcggatataccccggaatcagtatcatataacatgatgcggtactgtttccggggatatttgtcattgatatttaggcataaatatattattattattttatagtctaatgaagacaggggtactatgagatgacaactgcagattgcagaggaaatggccgcagggatacgctgcttcctatcatactgtgtttatgttttattgccagcagtattatttttcttgtacagatgattctgaaaagccagaaggagaacgtggcatacctgtatgatgccgcgaatcagacaaggacatccattataaaacagattgagggagactggcagacactggagggactggctgtaagtctgagggatttggtaatcctggatgagaaccagattatgaccatattaaaggatataaatgaggagaatgcttttatccggatgggctacgcggatgtccgcggcaatgcgcgcatggtggacatgaacggcaatgtccaggaggttaatctcagcggaatggagttctttgagaaggctctgcagggggaaaagagcatatccgatacatttgcggacccgcaggatgccagtggatatatcaattactttggtgtcaggattaatgacagtaaaggtaatgtcagaggcatactctgtgcggtccattcagctgtcatactgagggagattatcgacgcgccggttcttaagggggctggttattccaatatcctggatgacgatggtaattatgtgcttaagaccattaagacatatgagggagacatccttcctgaaaatagaacaaagattgcagaagtcataaagaaagagggcagcggtgattttattcttacagacaggcagggaatcaggcagatgctggttatccttcccattattgaggggcagtggtaccaggtaagcatggtgcctgtggatgtgctgcgttccagctacatccagacagcaggaggtatcatgaccattatcgtggtggcctgcggcctgtttatatggctgatgagcagacagcagaggatggctgtgaataaccagaagatgctgatgaagctggcttacagcgattcccttacaggtctgcgcaattttgcgggctttaagcgggaggcggagatactccttaaccgtcctgaactggcccgttctgagctgcccgcctatgtgctctggtatggtgacctgaggaatttcaaactgattaatgatgtgcttgggtatgaggaaggggaccggctgctcaggctggtggcggaattcctcagaacagtggaaagccccgaccgtatcagctgccgcatagcagctgataactttgccggcataacccggtgcgtggatatggaagcgctggacagagggctttgtcagcttaaggagtatatgagaaattcgggtatggacgagcagcccttcatggagattcccgtgggcgtctaccgcttccgtccgggagatgagaaacagtccctggatgtgctggtgaattatgccaacatggcccataagatagcaaaggaaagaccgggaacctcctatgtgttctatgatgacggcatccgcaggcgcatgctggaggattccgccctggagtctgaggctgaggcagctatggagaaccaggaattcatgctctatatgcagcccaagattgatatacagaacgggaaccggattaccggtgcagaagtgctggtccgctggctcagtccaagacgggggctgataccgcccggtgatttcatcccattgtttgaaaaaagtgagcttattgtaaaactggaccgctatatgttcgaacatgcatgccgctggtaccggatttatctggaacagggcaaaaggccagtgagcctggcaattaatgtatcaaaggccggtctgttccagaacgactttgtggattactacacgggcatcaaggacaaatattctataccggatggttttctggaactggagtttacggaaagtatcctggctgctgacacggaattatttgcggaactggtggttaacctgaatgcgcacggtttcatctgctcgctggatgattttggctcgggatacagttcccttaacctgctgaagaacctgcctatcgacgtgctgaagctggacatcctgtttttccacaagagccgggatatcaggcgggagcgtattgttgtgtccaatgtcattaacatggccagagaattgaatataaagaccattgcagagggcgtggaggatatggacaccgtggaattcctcagggatgcaggctgcaatgtgattcaggggtatgtttttgcaaagcccatgccgcaggaggattttgaacacctgctgacgaaataccaggacgggccttttggaggcatggatgataaatagataggataaatcaaatgaaaaacggaccatcccgccaggggacagtccgtttttcatttataccattacaatagcaggattaattcttttttactttaccggtatccttcggaagggtgacattcaacaggatagccaccagcgtagcgatgacaaccggagattttccgaagattgtggtaacccatgtggggaatgcggacagggatgcggatgcctgtgacacgcccattcccagggcagctgcaagacctacaatggaggtattgcggtagttcatatcttccgtcataaccagcttcataccggtcatggcaatggaagcgaatacagatacagtcgcgccgcctaagaccgcatagggaatcgtggtcagcagggcggagaatttggggaacagtccggcaaccagtataatcagtgcggaaagccctaaggtcacgcggttaacaaccttggtggtagccacgatacctacgttctggctgtaggtggcggttggcagacatcccaggaatgcacctatgatgtttgagaagccatagcccaggatagcgccgtgaagctcatttgtggtgggctcccggtccagacctcctgccgtggtggcggagaagtcaccgatggcctgcacggagttgatgacaaacagcagtcccagggccacgcaggcagacgcctcaaagctgatgccgaaatgcatgacctgagggagctggaacatgccggattcagccacattgccaaagcttaccatgccaaagaacatggaaaagatataacctgcaatcatgcccataaggatggacgccagtttcaggaatcccttggcaaaatggttcagcacagtaactaccaccagagtgaagatggcaaccacccagttctgccatgcgccgtaggtgggctggcccgcgccgcctgccatgtagttgatggcagtggggtagagggacagaccgatggtgaacacaaccgtgcctgcaatcagaggcgggaagaactttcgtatcttcttgatggtaaggcctacgagaatggcgcagacaccgcctacaatctgggctcccaatatggccgggatgccggactgctccgcaatggcctgcatactgggaacataggcaaagcttacgcccaggataacaggaaggccggcgcccagatggaaactgttcttattgcctatgggaaagagctgcagcagggtggcaagggcggatacaaccagggaagcctgaatcaacagaaccctgtctgccgtgtcaatgcctgctgcgccggaaattatgatggccggcgttacacagcccacaatcatggctactacgtgctgcagggccaggggaattgcctggctcatttttggcacaccatccaaatcaaacagggatgcgtgctgtttcactgtattgtctgtattcatatatcattgcctcctttacgctaaatggatatgagtaccggtttttccctggataccgtcttttgctttttccaacagcgtaatgagggcagtgcgtcctggttttgattcagcaaatttaacagcagcctgaactttgggaagcatggaaccaggggcaaaatgtccctctttgatatattctcttgcttcttctgtgtccaggtcatccagccacttttcttccggctttccgaagttaatagcaaccttttcaactgcagtgagaataatcaggaaatcagcattcagattctcagctaacagttcactggcgaagtccttgtcgataacagcgcttgcgccctttaagtggtttccctgacgggtaaccgggataccgccgccgccgcaggcaattaccagctgtcctgagtctaccagggagcggatagcgccgatttcaacgatttcagcaggctttggagatgccaccacacggcggtagccgcgtccggaatcttccttcataatgtatccgtacttttcctctgcaatcctggcctgttcttctgtcatgaagtggccgattggtttggaaggagcctcaaaggcagggtcgtctgcatccacgcggacctgggtaatcatggttgcaaccggaatatcatacatttcgcggttatagagttcctctctcaaggcattctgcaggtcgtagccaatataggcctggctcatagccacacagacggagagaggggtgtttggctggtttgcgtcctcgcggctcagtgcagccattgcattgttaatcatacccacctgagggccgttgccatgggcaacgatgacctcgcagccttcttcaataaggtctacgatggccttggccgtaatcttgactgctttcatctgctcaggaagggtattgcccagtgcattgccgccaagggcgatgacaatacgttttttcttgttttccatagtgattttcccctttataggacgggatatgagggtatcccgccgagtttttgcataatttgagacaaaaagggctgcaggactcagtccggcagcccttacattgtattacatggtaagatgaatggtttatttgaatactctgggtgttcctttttcttccagcttctttaagatatcagccgggtcagcgaacttagccagcataatcatagcagcaattacgtatggcttgtagcttgcttctttgtacagagggtcacggtagcggtcaaatacagttgcctcaacctcgccgtccttgcagcttacatcgttgatgtcagccggtaagcagtgcaggtacagagccttgccgtccttggtggtcttcatcagttcctctgtacagcaccagtctttgtgctctgcgttctgagccagcagttctttctccagagccttgatgccctcggaatcgccttctgcgtacaggttggttctcttttccatagctgcaaatggagcccagctctttggatatacaatgtcggcatccttgaatgcgtctgccatgtcatgggatacgcggaaggaaccgccggtcttctcagcgttctttctggcaacttcctcaacctcaggcatgatttcgtagccttccggatgagccaggacaacttccatacccatacgtgtcatcaggccaacaacgccctggggaacggagagaggcttgccgtaggaaggagagtaagcccatgtcatggctaacttcttgccctttaaattctctacgccgccgaactcatggatgatgtgcagcatatcagccatacactgggttgggtggtcgatgtcgcactgtaagttaaccagggttggcttctgctccaggatgccgtccttgtggccctgtgtaacagcgtcaacaacttcgtgcatgtaagcattgcccttgccgatgtacatgtcatcgcggataccgataacgtcagccatgaaggaaatcatgttagctgtctcacgaacagtctcgccgtgagcaacctggctcttgccctcgtccaaatcctgaacttccagacctaacaggttgcaggcagaagcaaaggagaaacgggtacgggtggagttgtcgcggaataaggagatgccaaggccgctctcaaatacctttgtggagatgttgttctctctcatgtagcggagagcatcagccatggtccagactgcttccagttcttcgtctgttttctcccaggtcaggaagaaatcgttctcgtacatttccttgaagttgaggctgtttaacttatcaatgtaatcctgtaatgttttcatttgattgactcctttaatatatttaatttttaatttgggtatcgttgttagaagttacaaaataatagggacatccattccaccagtaccttgggcctgagccgttccggcggccttcagcatagaccgccggaaccaaacaggtcacttaggacttcatggaaaatggtttacgaatgagcagtgcgaaaataaaatgtaagtgcagctgtaaagagttttctcttataaggatgcagttatattttatttttcatagggcgtatgccctatgtttcctggccgccccccaggccaagaagacggcactgcgggccagcgggccgcggccacaactgtatggcagccaagaaatcaccccgcggacaataaacgaattaaaacaaacacctgctgcaaaattacttacagtacacgctaggcagagcagcataaacagccgcacaggtaaccaaatcctgcttccatgtaatctcattgggagcatgggcctgagcttcagcgccaggaccaaatccgatacaaggaatgccgttgcgtcccatgatggaaacgccgttggttgagaaggtccacttatcggtgagaggacgtgcctttctcatctctgctgtggcatcaacgccgatacgctcgtcgccgaacaggttcttataagcttcctccagggacttggtaactttgtggtcctccgggataacccaggttgggaagtagcactcgattggatatgtaaggcccttataggaaggacgggaatactcatacatggatacggtaacgtcgtcgccgtatttcttaactgcaggaagagcacgaatctcatccaggcagctctcccaggtctcgcctgctgtcatacggcggtcaagggatacggagcaggaatcagcaactgcgcagcggcttggagaggtgaagaaaatctcggaaacagtaaccgtgccgcggcctaagaagttagcctccttatactccggattgtacttctcatccagcatcttcacaaggcccttaacttccttgtcatcagctgcatcgttttcgttcagtgcgcgtacatcctgaaggatgtcagccatcttatagatagcattgtcgccgcgctcaggagcggaaccatggcaggaaacgcccttaacgtcaacgcggatttccatacggcctctctgtccgcggtagataccgccgtctgtaggctctgtggatactacgaaatcgggacggaccttatcctcgttgatgatatactgccagcacagaccgtcgcagtcctcttcctgaaccgtaccggttacaagaaccgtatacttgtcgcttaacattcctaaatccttcatgattttagcgccgtatacagcagatacaataccgccgcactggtcagacacgccgcgtccgccaatctcggtgtcattctcatagccctcgtaggggtcgaaattccagttgctcttgttgccgatgccaactgtgtcgatgtgggcgtcaaagccaatgagggtttcgccggttcccatgtatcccagaacattgcccattgggtcgatttcaactttgttgaagcccagctttgtcatctcctcagcaatgcggtcgatgtgagccttctcatcgcagctctcgcctgggaacttaacaatgtcgcgtaagaacttggtcatgtctttctcatagttctgtgctgcttctttgatttttgcgtaatccagattcatttcttcgtttcctccattatacattgatatttggttaaggtgtgatataggtgattgtttgtgctttatttgtccagacccttccagacaatgttcttgtagcgctcagggtctgtatcgccttcggtggagaagagcagtaccctggaattctcatccaggccaatgtctttccttaagtctgcgtattcatccatggacatgacggctgccagtgcgccgaatggagctgcgccggattctccggaggtaacaggtgcgtcgcccttgatgggagcgcctaacatacgcataccggttgcggctacccagtcaggagcagcgatgaatactttgacatggttctttaagatatcccatgaaatggtgttgggctcgccgcaggcaagaccggccataatggtttccatgtcgccgtccacaatgcggatttgtccgtcaccggcagcagcgcccttgtacaggcaggcagccgcctcagcttccacaactacaaatgtaggaggattatcagcatagagattggagaagtagcctaccacagcgcctgccagtgaaccaacgcctgcctggacaaagatgtgggtaggacgctggcagccgtagtctctcagctgttcgccggcctccatggccatggttccgtaaccctgcataatccaggatggaatctcctcgtagccgtcccaggctgtatcctgtaccataacgccccttggcgtctcgtcggcttccttggctgccagacgtacgcagtcatcgtagttcatctcctggatgtctactgcagcgccttccttggcaatgttctgcagacgtgtctgggtggaacccttaggcatatgtaccactgccttctgtccaagacggttggctgcccatgcaacgccgcgtccgtggttgccgtctgtggcggtaaagaaggtagcctggccgaattcttctcttaactggtcagaagtgaggactgagtagggaagttcggatacgtccctgcctgtctccttggcaatgtagcgggccatggagaaggaacctcccagaaccttgaacgcattgaggccaaaacggtaggactcatcctttaagtagatttcctttactcccaggtaagctgccatattgtccagcttggtgagtggtgttttggtgtactgggggaagctttcgtggaatgtccttgccttcgcaatctcctccagtcccataatcggcaggttcttgtcatctgtcttaggcatatgattgaccgcccatagaatcttctggtccatgttacataatcctccttataatcatcacgcttttttatcttccgacttgcggctgtttacatcaatgtagctgtacaaagtaaatttggagattccgaagtacttggaaaccttgtcccctgattttgttataaggaaggcgcctgcatcgttcaggaactggatggcagtcactttttcctccttgttcatcagggcggccggcttgccgatgagggccaccgactgctctatcagggtatccagcaggtcgttgacgttgtggacaatctgttcgggctgctgcttcacgtccgattggggttcggtgtcgatgagagctttaatggaacggtccacggtcatcaggcctgtgatgtcgtaattaatggacaggaggtagtcaatggaatccccttcctcattacggatgtaaatggtgctggacttcagtatcttgccgttggatgtacgggtcaggtatccgagatggtctttcaatgaagccgggtccttgtgaagggtttccaggactacttttgaaggtccgtccccctcctggcggtttgtcacatgaccattgttgatgtgtacgatggaatgctccaggtcgtgtttctcaaggtcgtgtatgacaatctcacagtcaggtccgaactgtcttgcaaggccatcagcaagctgtttcagtaaatctagtgtgtatgacatggctttaacctccttttcctcggactcttcaaacctttccccggctgctgccggggacttaccgtttatggtgactttgtacaataaacatttcgcaaagttgtgatgcgttgtttatgattccatcatagcacaaaaaaaaggaattgcaagaggtttttacaaaaaaattttgaatatctaaaaatttttgcattttctgcttgcaaatggatttgtatggtgttagtataggggtacaggaagtcctgttctatcttattagagtttatgaattccggatggtgtttaggacaaaatccaagagcaggtacataaaatcataaaatgaaagaaagaaaaggagagaggttatgttagtgattgggaacggtcgtctggttaccagagacccagaacagccattttttgaaaatggggcagtggcaatggacggtaccgcaataaagaaggtgggtacgctggaagagattaaaaaagagttccctgacgccgaatatgtggacgcaaaggggggcgtcatcatgccggccttcatcaacacacatgagcacatctacagcgccatggcaagaggtctttccataaaaggatatgaccccaagggatttctggatattctggacggcatgtggtggaccattgaccgccatctgacgtgcgagcagacccgccagagcgcaagggccacttacctggattccattaagaacggagtcaccactgtatttgaccatcacgccagctttggcgagataaaggattccttatttgccattgaggacgctgcaaaggaaatgggcgtcaggacctgtctctgctatgaggtttccgacagggacggcatggataaggcaagggcggctgtgatggagaatgcgtcctggattaaacatgcgctggcagatgatacggatatgattgccggtatgatgggtatgcatgcgcagttcaccatctcagatgagacgatggagctggcggcagccaataagccggctgaggtgggataccacatccacgttgcagagggcattgaggaccttcatgactgccttaagaagtacggcaagagaatcgtggaccgtcttatggactgcggtattcttggggaaaagacattgctggcacactgtatttacgtgaatccccatgagatgcagctgattaaggatacggacaccatggtggtgcataaccctgagtccaatatgggcaatgcatgcggatgccctccaaccatggaaatcgtccacagaggcattctcaccggtctgggaaccgacggctacacccacgacatgacagagtcctttaaggtggccaatgttcttcacaagcatcacctctgcgatgccaatgcagcctggggcgaggttccgcagatgctctttgagggcaatgcaaagattgcgaaccgctatttcagaaagcagttaggcgtattgaaggaaggggctgcggctgatgtgattgtcacggactacatcccgctgacgcccatggacgcctccaatgtcaacggccacatcctgttcggcatgaccggaagaagcgtggtgaccacggtgtgcaacggaaaggttctgatgaaggacagggagcttgtgggaatggacgaggagaagattctttacgaggtaagggaagaggcaaagaagctggcccattccatcaacggttaattgccggggcagcagccggcagaagcaggaaaagccttccagggatggctggcttttcctatatataagcaatacaggcacaatgtataatttataagtgatatccgattgcagggcggcgggatttggcaccccgggatgatagtatctcccgggcggctgagccggatggaggacctgcggacatggtccgcggtatccggtgctgggacctggtctggttataaaggaggataagaataatatgagcgacattatgaccccgattccatttggaaaactgatgaactggattctcgaagagaacaaaaagggtgctgtattcggcatcaggaggccattcattgcagacccggacaaaacctacgagatttttggccgtaagctggaaactccctttggacccgcagcaggaccccatacccagctgacccagaatatcgtggcttcctacgttgcaggcagccgtttcttcgaacttaagaccgtacagaagctggacggcgaggaccttcccgtatccaagccatgtatcaaggctgacgacgagtgctacaactgcgagtggtccacagagctttatgtgccccaggcatttgacgagtatgtgaaggcatggtttgcctgcaaggtgctggcgaaggaatacggcctgggcagtcctgacggcttccagttcaacatgtccgtcggatacgacctggagggaatcaaaacagagaagattgaccgcttcatcgagggcatgaaggatgcctctgataccgccattttcaaagagtgcaggcagtggcttttagacaatctggaccgctttgaaaaggtatcaaaggaggatgtggaagccatttcaccagaggtgtgcaactgcgcaaccctttccacccttcacggatgtcctccgcaggagattgagcgcatcgccagatacctgattgaggagaagaaagtacatacattcattaaatgcaacccaacccttcttggatatgagtatgcaaggaaaatcatggacgatatgggctatgattatgttgcctttggcgatttccactttaaggatgacttacagtactcagacgctgttcccatgctccagaggctgcaggccctggcagatgagaagggcctggaattcggcgtaaagattaccaacaccttcccggtggatgtaaagcagaacgagctgcccagcgaagagatgtacatgtccggaaagtccctttatcccctgtccatgtccgttgccgggaaactggctgaggactttggcgggaagctgcgtatttcctattccggcggtgctgattacttcaatatcacggatatcgtggacgcaggtatctggccggtgaccatggctaccaccatgttaaagccgggcggctatgagagactggagcagattggacagctgtttgcagccagggaagcagctgcctttgacggcgtggatgcaggcaaagtaaccggtctggtggaggcggtgaagtccgacaagcatcacgttaaggcagtgaagcctcttccttccaggaaaatcaggaagccggttccgctgacagactgctttatcgctccctgccaggaaggatgccccatccatcaggatatcaccagatacctgcagctggccggagcaggcgagtttgagaaggcactggaggtcattctcaataagaacccgcttccatttattaccggaaccatttgcgcccataactgtatgagcaagtgtaccagaaatttctacgagtccccggtggatatccgcaggaccaagctggaggcggcagaaggcggatttgatgctgtcatggcaaagctcaaggctcccgcagtcacctctgacaagaaggcagccgtagtgggcggcggccctgcaggactggcggcagcttatttcctggccaggggaggcgtgaaggtgaccctgtttgagaaggaagataagatgggcggcgttgtccgcaatgtgattcccggtttccgtatcagcgacagcgccattgacaatgacgtgaagctggtggcggccatgggagtggaaatggtaaacggcagggaaatcacggacatagaggcgcttaagaaggattacgattatgttgtcctggcagtgggcgcatccgagcagggaaggcttaagctggaggcaggggataccatgaacgccctggatttcctggcccggttcaaggcaacggacggaaaggtggaattaggaaagaacgtggttgtcatcggcggcggcaacacagccatggatacagccagggctgccaagagaaatgccggtgtggaaaaggtttccctggtatacagaagaaccaggcgctacatgcctgcggacgaggaagaactggtcatggctgtggaggacggcgtggaatttgctgaactgctggcccccgtgaaactggagcagggagtcctgtactgtaagaggatggtgctgggcgaccttgacgacagcggacgccgcagcgtggtggagacagaccaggtggtggaggtgcctgccgacactgtgattgcagctgtgggtgaaaaggtgccgggcgcattttacgagaactgcggcattgccctggacagcagaaggcgtccccaggtgaaccaggagacactggaaacctctgtgaagggcgtatatgttgccggcgacggtctctacggtcctgccacggtagtggaaggaatcagggacggcaagatggcggcggaggctatagttggaaaggctctggcagaggacctgttcaggctctctgacgctgacgccatctacggacgcaagggcaggctggctgaagagaatgaccagattgttgacagcacacgctgcttatcctgcaacagctactgcgagaactgtgtggaggtatgccccaacagagcaaatatttccctggtggttccgggcatggagaagcatcagattatccatgtggactatatgtgtaatgagtgcggcaactgtaagagcttctgtccgtgggacagcgctccttatcttgacaagttcaccctgtttgccaatgaggcagacatggaaaacagcaaaaaccagggctttacggtactggatgcagctgccggcgcctgcaaggtaaggcttcagggcaaagtcatggattacacggttggttccgaaaaccaggatgtgccggacggcatccgtaaaatcatcaagacagttatcagcgactattcatatatgctgtagataaatgtgcgaattgccgtacaaaggagtcctcaatgaaaatgtggggactcctttagcaaaggtttgttaaaaaagtaacgttattctttttggagaataatgaaaggagaagaacaaaatggcacaaaagcgcaataaaaaagtagctgtggtgcaatgctttgggggctgtcatgcagaggcagacattttgcgggaggacctgacaggggattgccggcaggttatggcagagcatccggaaggcatactgaaatgtaaatggggatgtctgggtatgggcagctgtgtggcggcctgtaagctggatgccatccatataaacggctttggggttgcagaggtggaccggggcaaatgtgtgggctgcgggctgtgcgtaaaagcctgtccccagagcctgatacgcattaccacgccggaatatccggtttacccggcatgtgtgaaccaggatgcaggggtgcagacaaagaaggaatgttccgtgggctgcattgcctgcggtatctgcgtgaagaactgtccggcggatgcaatcaggatagaaaataaccacgcggtcatcgatgaagcaaagtgtatcgcctgcggtatgtgtgcagtcaaatgtccaaggggaatcatactggatgccgacggcattttcacagtaaaggcgtagaggcaggaggcataaaatgggagagaactattgttttacagtgaatggagtggaacgctgtaccagcgaggacaaaccgcttctgcgttatctgagggacgaccttcaccttcattccgtcaaggacggatgcagtgagggagcctgcggaacatgtaccattgtggtggatggaaaggcagtcaagtcctgtgtcctgaccaccagaagggcggtgggaaagaacattattaccacggagggattaagcgacgctgaaaaggaggcctttgtgtacgcctttggggcaatgggctccgtgcagtgcggattctgtacaccgggcatggtgatggccggaaaggcattgattgaccgtgtgccggaccccactgaggaggaaatcaaggttgccctgaagggaaatatctgccgctgtaccggatataaaaaaatcattgaaggcatccagcttacagcagccatcctgcggggggatgccaaaattgaggagtcccttgaaaagggagatgagtacggcgtagggaagcgggcattccgcctggatgtgcgggaaaaggtgctgggctacggcgagtacccggatgacgtggagatggagggaatggtatatgcatcggctgtccgttccaaatatcccagggcgcgggtgctggatatcaattatgagaaggccgcggcacttccgggggtgctggccgtgctcacggcccaggatgtccccaacaacaaggtaggccatctccagcaggactgggatgtaatgattgcaaaaggggagattacccgctgtgtgggcgatgccgtctgcctggtggttgccgagtccagggacatcctggagaaggcaaagaggatggtgaagatagactatgaggagctgacgcctgtgtgctccatccgggaggccatggcagaggatgcgcccaaggtccatgagaagggcaatttgtgccagagccgccatgttacccgcggggatgcgaagaaggccctggagaactccaaatacgtggtgacacagtcttaccgcacgccctttaccgagcacgctttcctggaaccggaatgcgcagttgcatttccttacaaggatggagtgaaaatatattccacggaccagggggtctacgataccaggaaggaaatttccatcatgctgggctgggacccggaccgtgtggtggtggagaacaagctggtaggcggcggcttcggcggcaaggaggacgtttccacgcagcacatagcagctcttgcagcccttaaggtgggaaggccggtaaaggtggtattctccagggaggaatccttaaatttccatcccaaacgccatgccatggagggcacctttacccttggatgcgatgagaacggtatctttacaggattggattgtgagatttattttgatacaggcgcctatgcgtccctgtgcggaccggtgcttgagagggcgtgcacccactccgtaggaccttactgctatcagaatacggatatccggggatttggttactataccaataatccgccggcaggcgcgttccgcggctttggtgtatgccagagtgagttcgctctggaatccaacatcaaccttctggcggagaaggtgggtatttccccatgggaaatccgctaccgcaatgccattgaaccgggaaaggtgcttcccaacggacagattgcagactgctccacagccctaaaggaaacccttctggctgtaaaggacgcctatgagagcaatcccggcagggccggaatcgcctgcgccatgaagaacgcaggcgtgggcgtgggcctccctgacaagggccgggcaaagctggctgtccatgacggaaagattgaattgtacagcgctgcctccgatatcggtcagggatgcgccaccgtatttgtgcagatggttgccgaggcaaccggccttgggagggaactggtcaggaatatgggagccaattccgaggtggcccctgattcaggaaccacatccggttcccgtcagaccctgattacaggcgaggcaatcaggatggctgcggctgatctgaatgaagcgctgcaggaagcaggtggggacttaagccagctggaaggccgtgagttctttgcggagttctttgaccccaccgataagctgggcgcggatgtacccaatccaaagagccatgtggcctacggatttgcaacccatgtggtggtgttggacgacgacggaagggtaaaggaagtgtatgctgcccatgactccggaaaggtagtgaaccccatttccatccagggccagattgagggcggcgtgctcatgggactgggctatgccctgaccgaggacttcccgttaaagaacggcgttccccaggcaaaatacggcaccctgggactgatgcgctccacccagattccggatatccatgcaatttatgtggagaaggaagaactgctgccctttgcctacggtgcaaagggaatcggggagattgccaccataccaactgccccggcggcacagggagcttattacgcaaaggaccatgtgctgaggacaacgctccccatggacgacacgtattattcaaagaaaaaataaacataacactggaaatgaacggcgaaaggcagtccacctgcttttcgcttgttccacataaggagatgacatcatggacaacacccttggcggaacagggcgtgggatgaaacatgaaggtacggacagggccattgaattccggtttgcagcgcctcaggatatacccatgattctcaggtttataaaggaactggctgattacgagggaatgcttaaccaggtggtggctacagaggagctgctgaaccagtggctgtttgagaaggaaaaggcagaggtgattctgggaatgaaggacggggagacagttggatttgcgctgttcttccataatttctccacctttttgggaagggccggcatttatctggaggacctgtatgtgcgccccgggtacaggggccgcggcttcggcaccgcctttttaaaccagctggcagccattgcggttaaacggggctgcggacgtctggagtggtggtgcctggactggaataaacccagcattgacttttatctgggaatgggagcccaggccatgagcgactggaccgtgtaccggattgacggggaacggctggaggctatggcggcggatgcccacaggtgacagggaaaaagggaaataggccggaacatatggttagattgacagagagaaacagaacaggagagtgatatatatgaagaaggtattaaaaggcggaaccgttgttggcggaagcggcagtgtccgggcggatgtgctcattgacggggaaaaggtggcggcagtgggaaccagtggggaaatggagcgcctggcggatgaggatacacagattgtggatgtggagggctgcctgctctttccgggcttcatcgacgcccacacccattttgacctccatgtggccggaacggttacggcagatgattttgccacgggaaccagggcggctgtcaggggaggcaccaccaccatcgtggacttcgggacccagtatgaaggggagagcctggcggacggactcaggaactggcatgaaaaggcggacggcaagtgttcctgtgattatggatttcacatgtccatatcggactggaacccatcggtcagcagggagcttaacgacatgatggaagagggaatcacctcctttaagctgtacatgacatacgatacccaggtagacgacaagactatctttgaaatcctgcgcaggcttaaggaggtaggtggaatcaccggggtccactgtgagaacagcggcatgatagccgcccttcaggcagaggcaaaggctgccggaaggatgggcgtggagagccacccagccacccggcccgctgcggccgaggccgaggccattgacaggctgctgaggctggctgaggtggtggatatccctgtgattgtggtgcatcttacctgccgtgagggctatgacgtaatcatggaagccaggaaaaggggccagaaggtatatgcggagacctgtccccagtacctgcttatggatgacagcctgtacggccttcccggcatggaaggggccaagtatgtatgcgctccgcctctgaggaaaaaggaggacagcgcctgcctgtggaaggccctggcggacggaaccatccagaccgtgtccacggaccactgcagctttaccactgagcagaaggcactggggaaggatgattttaccaggattccgggaggcatgcccggagttgagacaaggggaacgcttctctacacctatggcgtggacgcgggaaggattaccagggaaaagatgtgccagctgctgtcggaaaatcctgccaagctctatggaatgtatcctgaaaagggagttattgccccgggaagcgacgcggatatcgttgttatgcgaaccggcgtggaggacagggttgcggcagcggaccaggtgcagaatgtggactatgctccatttgagggaaggaagctgacggcccgtatagagagcgtgttcctgcggggtacccaggtggtgaaggaccatcaggtggtggtggaaaaggcagggaagtttgtgaagcgcgggaagtatgggctgtaggcagcagatgatattctcctggtacagatgaaaatataaaaatcggatggtaaaggacttacaaataaaaccagcagtcatgttctctgatatggggcatggctgctggtttatttgtattttctgtatatcttttgcgattccaaacaaccactgcattgtttggtcagcgggggcggagtgtgttttgtgttcatttgctcagaagaatctcgcggaatccctttgccagcggagaaagcgctgcatccctgacccatgtcagatatattctctggattaggggaacattggtagcaaggtgaagctccgtaaagcctaagcttctgaactgcttataaaaagtgcgggaaacaatggagatgcattggttggaaataacctcattaatcaatccgtaatcattataagcagctgtaagggttttcggcctgaaacctgctccttcgcatatttcatagagcaggcggttggtgccgttggtgcttacgttgtagacagcaaagggttcgtttttcagttccttgggctctaccagttttctgcatgccaggggatgcactctgcttatgacaaattttactggttccgtataaagaaggattttttccaggctggcatactcggattcattgtcaaactctccgcataaaccaagggtactggtataattgagcacatccttgatgatggctgtggtatatttaaaggttatattcaggctgcaatcgggataagcaagttggaattgagcgcttttcctcggcagaaacgtggtattgatggagcatagggcagataggtcaaccgtattcaggtcgctgttgacctgatgctttacagcggatattccatggttgatttcttccagggaacgttttgcataatcaaaaaagatacttccgtattttgtcagttctatgttccggccccgtttcatgaatagcggggcgccaatctcttcttcaatcccaagtatagcctttgtaagagtaggctgtgtgatatgcagatgttcagcggcgcgcgtgtagtgctggtattcagcggcctttagaaagtattccagatgttggtaattcatacgccctcccatttccaaaagttattaatcgttaaaaaaaagtaattagtaataattgcataaatatggttgaattatattagataaatcagtaaatatactcaagtgtaccttaattatagattaaattatgaatggattcaagcaggtgggggagtgattggacaaatattaggaaacagcaacgggaatcacatttttataaaaaaggaggaacaagaatgaaaaaaacaatgaagaaagtgattgcagccatggtttcagccgcaatgcttctgccgttagcggcttgcggaaactcaaatgccacaagtgccacggcgccagcagcagcggcttcgtctgacggagctgctgccgaaaagaaaggcggtgacgggaccggaagcccgggcggtgtggaccacacccagggggcgtcttttaaaatccgttttgccaccaattcatcggcaggggacgttgccggagagggaatcagccagaccggaaagggaatgatttatttctgcaaacagattgaagaacgcagcggcggccgcatcaccacccagatattcacggacggacagctggcttcgtccacccaggaatacattggcggcgcgcagaacggcgcatacgagatgttcatgctgaactgcggttcctgggcagattatacaccggcctatgctgggctgaatattccatatctgtatatggattacgacgatgcttatgcggtcctggattcgcagatacgtcaggaatgggaccagcgtgcccaggctgatacaaaatgcatacccctggcccatctggatattggcttccgccagctcacggccaacaaggaaattcacgctcctgcagacttaaaaggtgtgaaaatccgcaccatggtggacccaatccagatgaactgctgggaagcctttggcgccagtgttactcccgttccctatgcggagctgtataccgcccttcagcagaaactggtggatgcccaggaaaatccgccgtccaatatcgtctcctcaaaactttatgagatgcagagttactgcatgaagacaaaccataactttacaactaccatcatggctgccagcccggtgttttgggatacgttgtcagaggaagacaaggtgttcctccaggagctctggaaagaaacagaaatgtatgtccgctccctgacagaaaatttgtctgacggattctttgatgaaatgcagtcaaaaggtacaacggttgtggaactgacaacagatgagcttaaggtgttccaggacgtagccaagtcagtatggccgcaggtggaggaacagatgggttcggaggcgtacaataaactggttgattttgtcatggattatcaggcgaataaataagcaggattaaacggagggtatcgtatgaaagatggaaagttccacttgaaaacgtttctggataacatagaactgtacatatctgctgttttgttcataggccttacagtcctgctgtttgcaaatgtattctgccgctatgcacttaagcattcctttgcatgggtggaagaggttgccaccattgcatttgtctggatgatatggtttgccatgtcggcagctgtaacaaagagaaagcatctgtgcattgattttgtgctggagatggttccgttcagagtcaaaaagggaatgcttgttatctcaaatggggtttttgcggcttttgacatatacctgctgtatgtggtgatgacaatcatcgggagacttgggaacagccagaccacgcttctgagacttccccagcagatggtgtattctatcattcccataggcctggtgctgagcgtggtgagaattgtacaggatacagttaagcttatacatgaaaacgaggccaatcttggcgcttccaagcctgcaatggacctggatgaatgcgaacggatttatctggaaaagagggctgcaaaagaggcgtctgcagtgaaaggagggatgcaatagtggctacaggtattatgtttcttgtaatgttcggcctcatgtttctgggagtgccgattgcggtggccatgttcatcagtatgtttgtactgattcatattgacccggttaccaccagctcctttattgcgcagacaacctatggcggcgttgcaagcttcaccaatctggcgcttccgttcttcatgatatcaggaaccattatggagacaggcggcctgtccagacggctggtgaatgcggccaattctatcataggcggcgtcacgggttccctgggtatggttactgtcatagcatgtatgttctttggcgcggtttcaggttccgcaccggctaccgtggctgccattggagccatcatgatacccatgatggtccaggaaggttataacaaatattatgcgaccgcccttgcctgctgtgccggcgggctcggcgttatcgtgccgcccagctatcccctggttctgtatggcgttacctgtaaccagtccgtgggggacctgttcattgcgggccttctgccgtcttgtgtggtgggtggaatccttattcttatcaattacggatactgtaaaaagcataagctgaagggagagaaacgtttccgcattaagtcggcactcagcgcctggtgggatgccaaatgggccttagtcatgccggtcatcatactgggaggaatctacggcggattctttaccgcaaccgaggcagcggtagtggctgttgtatatggtatcttcataggctttgtggtatacagggagttgaaagttgagaagctttgggccgtattccgggacaatgccgcattcatagcgggcaccatgttcattatgtgtccagcgaaggccacgggctctgtgtttgcttacctgaatatcaaccagaccatagcggattttatgttcggcatatccagcaattattatgtggtcatgttcatgatttttatcatcatgttccttgtgggaatgttcatacagaccacaccagccattatcattctggctcccacccttttgtcggttgttacccaggtgggatgcgacccgattcactttggcattgtgctggatttagcccttgccatcgcatttgtgacgccgcctgtggccatcaacctgttcgtgggttcgtcccttacaggcatcagcatcgacaagattaccaaagcagagatgcccttgctgctcggtctgattggcgcattcttcgtagtggcattcgtgccggcgatttcactgctcctgcttggccgggtatgatgccggatatcctgccttgaccggagaaactaaactaagtatcaggagggaacatggatatcctatatctttccattgtgtttctggtaattgttgtaatcatatggctgaagaagcccttatttgtagcaatgacagggggaatagcagccactatcattttattccgcgtaaatctgaaggatgcagtcatggttctggggcggcagaccgtggcctgggataccatagacgtattgctgagcttttatctcattatatttctccagctcatgcttgagaaaagagggaagctggcaaatgcaaaggattctttcagccgtctgctcagaaaccggcggatgaataccattgtatcacctgcaatcatgggacttcttccgtcagcagcggttatgaccatctgcgcagatatggttgacaagacatgcggggaatacatggacgctaaaaataagacctttgtatcatgctattacagacatataccggagatgttccttccaacctttccggctgtgcttctgggacttacactcagcggacagaatgctggcctgtttgtactggccatggttcctatggcagttgcagcatgcgccgtggtatatgtgacacatttaaaaaaactgccaaaggaaatgccgcagatggaggatgcagttgacaaacgggcggaaatcgtccatctggtaaaaaacctgtggaccctgattgctgtgctgttcatcatcattgcatttaattggtccgtgtgcatggcagcgcctttggtcatcgcagcgaattatgtacttgaccatttcagcataaaagaactgccggaccttatggtacggtcggcggaacccatactgctgggcaatatgtatctcatcatgctttttaaaggcatattgtcccacaccggcgtcataggacttctgccttcctttataggccggtttcctatttcgctgaccatgtccttcggcctgctgttttttatcggcacggtcataagcggctcccagacaatcattgcactctgtatgccaatggcgtttctggcatttccccagggagggattcctctccttgtcatgctcatgagcattgcatgggccgcaatgcagatatcgcccactcatgtctgctcctttgttgcagcggattattatcacaccacactgggagacattgttgtgagggcatttattccggttattgtattttccattatctcgtatggatacggagcattgcttggaaggattttttattgaaggaagccgccggaaaaaactatgccattgagatatgtatataaggcacagtgaaacccgtcaacagttatatatggataaggagaaagatttatgaagatagcaagcgcaaaattatttctgactgagtataaccgctccaatacgcccgaatttccaaagaaaagcaaggtggtgggaatccgcatttacacggatgaaggtatttacggggacggcgaggtggcaggaatccatgcaaccttcggggccttcggcgtcataaaggatatgtggccttttattgcagggagggacccctttgagaatgaggtactgtgggaccagctgatgctcagaaccttctggggacaaaacggcggcgcgttctggtacagtgcaatcagcgccattgatattgcactttgggacatcaaaagcaaggccctgaatgtaccgttatataaacttctgggcggtaagcggcgggataaggtgcgctgctatgcctcgcagctgcagttcggatgggggcctgctgattcaccggccataaccgtacaggactatgtggacagggccaggcttgcccttgcggatggctatgacgccattaaaattgacttcctgaactgggatgaaaagggaaacattttaaatgaaaccaaccgtctgggcctgcttgcgccggagctcgtacaggttttctcagaccgcgttcacgctgtcagggaggcaatcgggccaaagacagaccttattattgagaatcatgcgggtaccaattccaattccgcaatccagctggcggcagctgtccaggactgcaatatttactattttgaggaacccaacacacctgtattttacaataacaagtatgtaaaggataatgtgaagatgccgctggcccatggggagcgcgtgtttggccgttgggaatacataaggtatttcctggacaattccatccaggtcatccagcctgatatcggcaatgcgggcggcatcacggaaaccaagagaatctgcgatatggcgtatacctttgatgtgggggtccagattcatacgtgcgcatcccatctgctgacgccgccgtccgtgcagctggaggcttgtatacccaattttgttattcacgaacagcatatgcgcagtatgaatccttccaacatggaactcacaacaaagattgtgctgccaaagaacgggtatctggacgtgaccgatgagattggcattggaaaccagtggtctgaaaaggcgcttgcatccgaagaccagataacgcttaattaaagggggaatcataagatgaagattacaagtgtggaatgctacaaaggggcgtttattacaattaaggtgaatacggacgagggtatcagcggttttggtgaagcagggctttcttacggcagctgccagaatgcagcgtggggaaactgccaggatttcgccaaaatggtcattggcatggacccctttgacacggagaagatttatgaacatctccaccggcatacgttctggggcatgaatggaggcgtcacggtatccgccgccatggccgccattgacattgcctgctgggatatcaagggcaaggccctggggctgcctgtttataagcttctggggggcaggacccatgattcgctccgggcatacgcatcccagctccagatggggtggaggacccttatcacaaaactggaccggtccgagctccagtttgagccaaaggattactatgacgctgtaaaggacgccatggcggacggatatgacgctgttaagattgacccctgctttgccgggctttccagggaggattttaaccaggcttatttaaaaagaggtgataaccttaagggggcttacccggaggcactgagaaagattgcagtggagcgtattgcggctgcccgcgaggcgggaggggacgagcttgacattatcatagagattcattccacccttgacgccaacacggctgtggttttaggcaaatccctggagccttaccgcatcatgtactatgaggaacccaccatgccttccaatccggaggtcttcaagcatatcaaacagaaatgcgacatcccccttgcaaccggagaaaggagctacacacgctggggattcagacagttttttgaggacaggacgctcagcattgcacagcccgacctgtgcaatacaggggggattacagaggtcaagaaaatctgcgacatggcgaatgtttatgacatcggcatccagcttcatgtgtgcggcggtcccattgcaacggctgcagcccttcatgtggaaaccgtcatacctaattttgttattcatgaggaacactgtgcgaatttcaagacggattaccagaaggcaggcaaatatgcctgggctccggtgaacggcagctatgtgatgaacgaccggccgggaatcggacaggagatgagcgaggaggcaatggagtcctatgccagggtagtggttgactagatttgggaaagcaggcggtaaaatgcctgcttttccttgtgggggacaggaatgaattctgcttttcagagggtgcttttctgtgaggaatgtgataaaataactagaatatcagattaacatacaaaattccggaggtaacagcatgaataagatggaacagataaccgttgtatatttcagccccacgggcggcaccaggaaagcctgtctcaacctggccatggagatggggaagaaggtcaaggatgtggacctctgcagcctggacggagcgtattcctttgggccggaggataccgtgattgtgggcgtgcctgtgttcggcggcaggatacccgggtatgcggcagagaagcttacatatctgaagggcaacggggcagtggctgtaacggctgctgtctacggcaacagggcttttgaggatgcccttctggaactggacgactgtttaaaggagcagggatttaagattggagcaggggcagcgctgctggcagaacactccatggtccgggatattgcggccggaaggccggatggcaaggaccagaaggaaatggcatcctttgcagcagggattcttgaaaagctggaaggggacggctggcaggagcctcaggtgcccggaaacaggccctaccgcgactggaagcagatgccggtgattccgcttaccaatgcatcctgcatatcctgcgggctgtgtgctgccagatgtcctgtgcaggcgattcctgtgagcaatccttcttccacggacccgtcacgctgcattctgtgcatgcgctgtatctctgtctgtccggtaaaggccagaagcctgcctgagcaggcatgcgccatgctggagcagaagctttctcctgtcagggatatcagacgggaaaatgagctgtttttataatccccctattgaatcccggtgcatttcggattataatcttaagatgtacttgtaaaaggatggaaatatatgatgggtgatggaacggacaggctggctgttattggcatgggatggattggggagtatatggttccctgttacagaagcctgctgggggaaggatatgaaaggcggatgtttgcagtaaaggccagtccgcggggactggagcagctgagggacagatacggctttgaaatcatggcaggcggttgtctggataagctgaaggaatataggcccgccacggtggtgctttccgtcaggccccatgaggtggcgggggtggcggaggataccataaagccttatgcagagtaccgcagggaactggggctgggcggtctgctgctgctttcttttgcacccagtccccgcccggaatggtataccaggactctgggaaagggcgtgaaaaccgtgtgcattctgcctgccatggagactgttatcggcgggctggatgtgtattcgctggcgttcaataagattacatatgaccctgcctgtcctcccggccggaaacagctggatgatgtcaggcgtttcctcaatcctcttgggcaggtatttgaatgtacgccggatgaatccctgcgcctgctgtccatgagcattacctatcatatgctgtaccttttatgctttggcctggaaccgtattatggggataagggcggcaaagacggtacaagcagtaaaaacggctgtgccctggctgctgctgtcctgtatgcgctgaaccgccggagactgggcctgcccggtcttattacgcccggtccggcgccggacctgcagcagatggatgaactggcctggctggaaaaaggatggtatgaaggcgctctggcatttgcctgcggggaaacaggtgaaggagccggaaccagggcccggggggaatgcggtgggagagccgggaatgcagacatcattgcccccagatcctttgagctgcaccttctctcgctgcagctggagaccagggaattcctggagaacaagctgaaggaccacgccacgccgggaggcatgacagaggaagcggtcaatgggttcaggcagctctgggcagaaaaaggctggctggaaaaggactggccgggaaaagacgggccagggaaggactggcggtatggggatgagtccatagcctatgagatatcctgcaggctggcggaacgggtttacaaaaaagggaaggcattggagaaaagaagatgaagacaaagaagaccctgaaagaaaccgtggtggagggaatctaccgggagatagaagaaggcatttataagcccaacgatatcatccatgaaggggaaatcatggagaagtatgccatgagcaaatcaccggtgcgggaggcccttattgagctgtgcaaggacaatgtcctgaaaagtataccaagggtggggtaccaggtggtaccggtgaccctgaaggagatactggaccttctggaattcaggattgatgtggaaaccgccaatctgaggcggctgagccagaggattagccctgaggagatagagcggttaagacagctggataccatcacaaaggataaccatgagaggatggtggccatccactggaaccgcaacacggatttccacttaaagctctgtgagatgggaggtaacggctatatctgcgatgtgattgccgctgcccttcaaaaatcctgttcgtatatttcccaatattttcagacagcctggaaaaagaacgccgaatccaacagcttttaccacagggaaatcattgaggccctggagaaccgcgatacggagcgggccgtggaaatgctccagaaggatatactgaatgtgaaggagcagattcaggagaattattccctctaaggaacatggtccggggatatggatgaaaatgcataaatactaaggatgtaagattgatactgtcaattttacatcctttttttgaataataatcggatatggtgtgaaaataaacaaaaacaacgggggataacaaaaatattttagaaaaatggttaaaaattatttgacacggcctgccaatggtgctataatcgctattagtaagattactaatcacatcagtagtatgattaatggaggagacagccatgacaaaaaaagagagagtgatagcagccatccggggagaagaagttgataagatacccagcggcttttccctgcattttccaaaggaaacagcgtttggggatgcagcagtaaaagctcatctgaaattttttgaggaatccgatacagacatccttaaaattatgaatgagaacctggtaccctatatgggcgagattaacaagggttccgattacagcctggtaaaagagatgaccatggaagacggctttatgcaggaccaggtggagctggttaagaagattctggctggatgcgacagggatgcatttattctgggcacccttcacggcatcacggcatcatccatccatccgcttgagaagatggaccccggctatacatatgaccaggtaagggaaaagctttgccgcctgttgcatgaggatacggatacggtcctggcaggtatgaagcgcattgcggatgtgatgtgtgagctggcaaggacatacattgaactgggtgtggacggcgtatattatgcggctctgggcggagagacacggttcttcacggatgaggaatttgagcagtggattaagccctttgatttgcagattatgaaggccatcaaggacgcgggcggttactgcttcctccacatctgcaaggaccagctgaacatggaccgctataaggattacggcccttatgctgacgtggtgaactggggcgtgtacgaagctcccttcagcctggaggacggcaggaagatgtttgcaggaaagaccatcatgggcggcctgccaaaccgccacggcgtgctggtggacggaccggcagaggcagtgaaggaagagacaagaaaggttatcggggaattcggaaggacccatttcatcctgggagccgactgtaccctggcaacagagcaggatatgaatcttttaaaggcagccgtagaggcagccagggaataaagaagcagtgaataggaaaaggaggaacagagaatgatgaaaagaaagttagcaatggcacttgcagtatccatggtggtaggctcacttgcggcctgcggcagcaagaccgagtcagcaggcacaacagcagcacctaaggcagagaatgcccagggcgcggagagcggggcggcagccggggattcagaggcagcggatggtgagaagaccgtgtatcccgcaggaaccctggtggtctatgccatgggaaatccccagtacaggcagcagtggtttgagacctggctggagaaccacagggatattgcgccggatgtaaagattgaatttgtacagacagagggaaccgcagacatccgtgaaaaaatcaccatgacagccttgtcgggagccaccgaggaccttcccgatgcagccatgctagacccggtaaccatcatggatttggccggcgcaggacttctgaaggatgagacagactatctgacgccccttctggataagatggtggacggagcaaccactgacgcaaccatcggcggacgcatctatgcgcttccggattccgtaaggccccaggtactgttctacaaccaggagatttttgacaagtacggcgtggatgcagagcagatgaagaccatggagggctacattgaggcaggacgccagttaaaggaaaagagcaacggggaagtttacctctcctatattgacccaaccagcaagacctggagatactggggccgcagaggtcttatgccgtcagcaggagctaaaatctgggatgagaacggcgaagtcataatcggcagcgaccagggcacacagaaggcattgggcgctctggacaccatgaactccgagggcttactgttaaagaccaccatcatggagccggccctttacgacgccatcaacaaacagcaggtagccaccttctgcatcggcgctttctgggatgagtttatgagaaagaactgtgaggccaccaagggacagtggagagttatgtcagctcctgagtttgaaggcgttggcaaggcaggcgctcctgtatcccagtacatggccatcatcgaaaagggcgacaatccttattccgagctgttccgccagatgtggtatgatttcacctttgacaccgaggcaaaggaagtgtgggtaaattccatggaagagcagaacgcaccgtattccaaccctgtatccaaggaaatgctggaagacccattctggaaagaaccgtctgatttctacggcggccagtccttccgcgagatggagggcaagtgccttgagaacggcgcagccaacctggtggtaacacctcaggatgcagaggcggatgaaatcatatctgctgagctggagaaatatgtggcaggcaaccagtccatgaacgacgctatcgccaacatggataagaacttaaaggctaagattggcaaggctgaaatcagccagtaatacatgaaaaggctcccgccccgaggagggagccttttataaaccttaaggaggaggtagcgaatgttaaaagcactgaaaaaatacagggctccctatctattcatcatgcccttttttatcctgtttcttgtatttcagctggtgcccaccatatggacattctatatcagcctgacaaactggaagggaatcgggactccggatttttgcgggtttgacaactacaggaaaatgctgattgacgatatgttctgggaatccctgggcaacacagtggtctactggctcaccggactggtattcatcatctgctgtgccctgctcattgcatccttactgaacagcagatacttaaagagtaattccgccagggcatttttcaagacggctaccttccttcccaatatctgtgcggccattgcaatgggtcttatcttcaggatgctgtttgatgagaacgtgggcctggtcaatgaggtggtgacaatgttcgggggcagcaaaatcccctggcttaccagcaccacattttccaagataccggttatcatcctgaatgtctggagatatacaccgtggtttaccatgattttattgtcaggactgctcaacatatccaaggattattatgaggcggccacggtggacggagccaacgggtggcagcagttctggtttataacccttccgtccttaaagaacatcctgttcttctgttccgtcacactgaccgtggatatgtggaagctgttcaatgaatcctatatccttccgggaccgggaacatccaactcatccctgttccagtacatgtacgagtcaggctttaatgtattcaatatgggttatgcttcggcaatcggcgttatcctgattcttatcctgattgtcatatccatcatccagtttgtggtaagacacaagcagggcgaaatatagaaggagggaatgaaatgaacagaaagaaaactgcatccactgtccttgtttacggcgtgctggcattcatcaccattgtctgcctgtttcccattgtgtggatgtgcctgatttccatcaagagcaccagcgagagcatcacaggatttaattccctgatggtatccaatcccaccatggccaactttaagcgcctgtttgagatgattcccgttggacagaatgcctttaacagcgtgttcaccaccatcatgggaaccattacctccctgtttttctgcgccctggcaggctttgcctttgccaaatacaggtttcctggcaggaaattcctgttttactttgtcattgccaccatgctggtgccgcctgaggtgggaagcgtgcctttgttcatcatcatgaagaaggtggggctcattaacagcctctggtccctggtgattccaaggattgccaccgcagtgggtatcttttacatgaaccagtatataacagatgtgccggatgagctggtggaggcagccaggattgacggatgttccgattttggcatctttaccaaaatcatccttcctgtcatcaagccggccatggcgtcttggggcgccatcaccctgattgccaggtggaatgatttcttctggcctctgctgtacttgcgcaagcaggcaaagtatacgctgatggtgaccatttccctgctgcctgtcagcgagggcttatccaccccgtggcctgtcatactggcaggcaccaccctggttatcatacccattatcatcctgtacctgattctggagaagttccagaaggccggaatgatggagggcgcggtcaagggataacgaaaagcacattgacaagagaatgttttttgcctatgattatggcataagcaaagacaggaaaagcaacagcattttcaggaatattgcatgggcagtgagcctggacggacagcgagtcgctgcccggagtgaacagcagagggatgagtccgcaatctgcgccggggtacatccgcacatttcatgtgccggccgccagcggcccggtacccctatgcatcttacggtatccggatacgtgttgcttctcctgtttttgttttacgaaaaaatactggaaagagggggcgcaggctccgggagggaagagatatggctcaggcggatttgtggaaatattgcagtacggagcattgcagggaaatgctgctctccttccggctccttggaaccagggactggcctccggagaaaataatgggctgtctctatgccctcagcaaccatgcgcaaaggcattaccggaaggtgcggatacctaaaagaagcggcggttacaggacgcttctggtgccggattcccttctgaaggaagtgcagagaaacctgcttcaccatgtactggacggatttgcggtgtccgccagtgcggcggcttaccgcaaaggcgcttcggtagctgccaacgcagggattcatcagggcaggaagattgtcatgaagatggatattgaggatttctttggcagcatcacctttcccatggtgcttcatcacgcatttccggccgcctatttcccgccgccagtgggcgcaatgctggccgccctttgctgctgccatgaccgtctgccccagggagcgcctgcgtcgccggctgtttccaatcttgtgatgaagccctttgatgaatatatggaggcctggtgcggggagcgggatatcgcttacagcaggtattgcgacgatatgaccttttccggtgtttttgatacggctgaggtgaagggaaaggtatacggcttcctcaggtccatgggatttgagccaaaccagagaaagacccgtattctgaccagaggaaccagacagacagtaaccggcctggtggtaaatgaccgtgtccaggttccggccccctacagaagacgtctgcgccaggagatttattactgtctgaaatatggggcggaggaacatttgaggcggaccggaagggacgcatatctgaaggaaggggatgccggggtaaaacggtatctggagtccctgctgggcaagactgcctatgtgctgctggcaggcggcggggatgcctggtttagggaggcgcaagtgagacttaagagcatggtgcggcaggggatatgaaaaaggggagtatgacaaagtggagtatgacaaagtggggtacggcaggcgggccgggacaatgccatgacggcatgttcccggcccgcaatgactgtctgccgcgaaagcgatgagaggggcctacaccccctgtatgaccggctgaatctgcctgccctccagggcttccttcaaggtgtcctctatgagtccggtatgggcaaccatggaggtgggctttttcaacgggtcatcctggccaaagggaacaaaatagatgttcttcatgttgaacagaagtccgatgttcttaaggttcatgccaagggcatcgttggtggatacggaaattaccaggggcttgccgttgcgcaggtgtgctttggcagccatgagcaccggggtgtccgtgataccgccagccagtttggccagggtattgccggtgcagggggcgatgaggaggacgtccaggtatcctttcgggccaatgggttccgcctcctctattttcagtattggctttatttccgtgatggatgttatgcggtccatgaattcgccggtatccccgaaacgggagtccgtggactggacactattcgagaaaatggggtgcaggatggctcctgtctccttcagttgcctgatttcctgttctatctttgcaaaggtgcaaaaggacccggtgacggccagacctacattttttccttttaattccataatattctccttattccttactgagtctgtgaatcccggatatgctccatgacagcctcataaagaatcctggcagaggaaaggggggaatagcgtccgggaagcccggggcataacctggcccggatattccggcgctccagtgccagaaaatccactcctcccggtgcagaggcaatatcaataaccgctgcattgtcctgaacctgttctgccagtgctgcatccagcaccaagaatgggatggtgttgaatataaaatcaaattctcccataattggttccagttcctttaacaggcaggtattgtatcccagacagcgggcgctgaccagccgtgaggaatcgcggccagccacggttaccccggctcccatgcccttcagacggtctgccaggatggaggcgcacctgccccatccggttaccaggcagcggctcctgtaaaggttcagcggacttaaggctatggcctccgccacagcgccctctgccgtggcaacggcatttttccatgcaacctcctccatcctcatgaaatcatggcaggggatggagagggagccgcagcgttccctgacagcggaagggatattccccccaaaaagtgtatgggtattattcagagcggccgtgaaaccatggatttccaggccgggcaggctgttgacagagaaaatggtgctgccgtccttggtaaaagggacagggcagaggatgatatgggaatcctccatggcctccctgagggagaaggaggtaggtttgtcatagtaaaagagagttttatggccggtctgattcagaagccggttcaggcaaatctgtctggaatctccgcccagtatgaggattggatgcatggatacgctccttatgagattggattcataatgtcactatatgacaaaaggaaataattggtaccattaggatgagtttgtcatattttcatagtataatggtaactgttcagaacagcggaaaaattggcttttgggtcaggaggaaacgccatcctggaccgttacgaatcacgattgaatcgggggactgatgtttatgagacacagtatttttgagggcagcgccgcagccgtggtaacgcccatgaatggatatggtaatcttgattttgacgcctttgggcggcttttggagtggattataagggaagggacagacgctgtggtcgtaaacggcaccacaggggagtcggctaccctggacgataaagaaaagctggctgtcatccggtatgccataaggcaggtggacggcaggattcctgtgattgcaggcacgggaagcaactgtacggaacacgcggtggagctgtccaggaaggcccaggagctgggggcggacgccctgctgcaggtgacgccttactacaacaaggcatcccaggaagggctggtgcgccactttacccaggtggcggaccatgtgggcattcccattcttttatacaatgtacccagccgtacaggagtgaccattcagccggagacatacaagattctatcggagcatccgaatatacgggggacaaaggaggccggcggcaacctgtccctgattgccagaacagccgccctgtgcggggagggatttgatatctattccggcaatgatgaccagacccttcccatcatgtccctgggaggcaagggggtggtatcggtgctggccaacattatgccaaaggagacacatcagatgtgccgcctgtacctggacggggatgtgaaggagagcaggcggatgcagcttaagcttctggatatcatggaagccctgttctgggatgtgaatcccataccggtcaaggcagcccttggcatgatgggtatctgcggggacgacctgcgccttccgctgacgcccatggagccggaacagaggaaaaaactggcgggtgtcatgaaacggcatggaatcagcctgaaaaaagaattgcataatcagacaaatctgctataataaagggagtgaaagaatagcagtttggagctttatgcacagagaatcaaaagccggcagcagccattgcgacaggtgtttctgaaactatcagatgccttataagaatggtttgcccggcttttatctttgaggacgttattcttaaaaaaacataaccaatcaggaaaagggggcatatcattggaacagaatcagcttcactatgggctatcactgaaattatattttgaaaataaggcattcggacccggcatgtcggcattgctgaggggagtggaaaccaccggttcccttcagggggcggcccaggccatgaacatggcttacagcaaggcatggaagatgctaaaggagtcggaaaaggcatgggggttcatgctgacggagcgggagacaggaggcagggacggaggcggctccaccctgacgccccaggctatccggctgttggaggcatacgacgcctttatggctgagaccaggcaggagctggaccggctttttgaaacgcatttttcaaaggaatgggtggaggagctgaagcaatcggctgaacaggcaaaagaataatttaaaatggaaggaaatggatgtaaaatgacggaacgtacaaaacaactggtaattgtcagaggaggcggtgatattgccacgggtaccatccacaagctttgccgctgcggatacccggtgctggtgctggagtcgggatatccttcggcaatccgcagatgcgtagccttttccgaagcagtatatgacggtacgtctgaggtggagggtatcacctgcatcaaggcttccgggtatgaggaagcctgctccattatggaacagggagcagtccctatcatgattgacgagaattgccaggtgctggggaaggtgcgtccatgggctttggtggatgccattctggcaaagaagaatctgggaaccaccagggatatggcggacaagaccattggactggggcccgggttcacggcaggacaggatgtggaccttgtgatagagaccatgagaggccataatctgggccgcatcattggaaacggaaaggcggcccccaataccggtgttcccggaattatcggcggctatggggcggagcgggttatccattccccggccaaagggattttctttggcaggtccatgattggagacatggtggaacagggacaggcgattggcgttattgtgaccgggcagggcgaggtcacggtggaagcatcccttacagggcttttgaggggaattataaaagacggatatcccgtggtaaagggatttaagattgccgacatagaccccagaaaaagtgaatatgaaaactgcttcaccatatcggacaaggccagatgcatcgcaggctccgtggtggagggtctgcagatgctggaggtgaagcaggggtactgattggaaaacctatacggcacagaccgcgcatttttcttccaggatttctgtgagggctgtgccgctgctggtgtgacagcggacaatctccgtgctgcttcccacttcgtccagggcgcagcgtatcatcttgtgggatacggtgttggtaaacaggaccaggaggtcaggactgccaatctgtttgtccaggctggcgctcatctgggtgaatacctttgccttacatttgtaattcttgcaaatctttttatattggcttaccatgcggtcatggcctccgataatgacaacgctcatgaaaatcctccttttgtggtgtccatattggttagttaaagctaacttcgtaatgacataatacaataattctgtaaaattgtccagccctgcacatgagaaagtttatcatgtttaaagggcgtatttccggtctttggcggaaggaagcaggagaggagccggggcagagggctggggtgaaagactccggcgaaaggccgcattttacaaacagggaaaaatgtgatatactatataaataccccgttaacacttgaacagtatctgttcggaaaggtgggaatttgtttaaaaaaggagaatatattctctatggaactgtaggcgtatgccaggtggagggcatatcgaaacctgacttctcgaataatgacaaggtgtattacagccttgtgccaaagtttgaccaggataccaccatctatataccggtggacagtccaaaggtaaagatgagggaaatcatgaccaggcaggaagcagagcagttcatactggcactgccgtctgttgaaggcaagcagtatgcaaacgataaggaacggccccaggtatacaggcaggtccttgaatccggcgattgtctggaactggcctccatgattaaggagatatcagagatggagcagaaccgtaagggcaagggcaagcccctgtccatccgggaacgggacggcgtcaagagcgcccggaaactgctgtttggagagctggccgctgccctgaacatctgccctgaggagattcctgactatattaccagtcagattggggaagcctgatgaagcctgtgaaacatttaactattttcttttagtctgaactgtggtaaaatcttgagttggaagaatcagattcttaacttgggaaaggcggcaggagagatgaaaaagagtatgcgtacccgtggacagatgtcggaggctgtgtcaacgggtatttttttgactttatccggaggtttccaggatgcttatacgtattactgcaggggaaatgtgtttgccaatgcacagacgggaaatattgtgctcatgggaagccatctggctgccagggagtgggccatggctgtgcgctatctggctccggtcctggcttttgcagggggcgtgtacatggcagagcatgtgaagcggcttcaccggcaggaccggcgttttcattggaggcagctgattgttgccattgaaatcaccctgctttttgcagtgggatttctgccccagagcatgaacatggcagccaacatcattgtctcctttgtgtgcgcccttcaggtcaatgcgttcaggaaaatcaagggaagcccctatgccaccaccatgtgcatcggaaacctgcgaagcgccacggaaaacctgtactggtaccgtcacacaggcaaacaggaccaccgggacaaattcatacgctactatggggtcatcggcatatttgcagtgggagctgtcatgggaagcgtgctcacggcgcatctcagggaaaggaccatatgggtcagctgcgggcttttgctggtcagcttccttatcatgttcgtgaaagaagatatagaaggcgaagaaatggagacatatggaaaataaagaaaacagggaacctgacagctgtttctgcgggtacggtttatccgttgaaatcatggaggcattgtcgctgctggggtatgagcatcccacgaaggtacaggaggaggtgctgccccaggtgctggcaggcagggatgtggtggtgcgctcccagacaggaaccggcaagacagctgcatttgtcatccctttgtgccagcagattgtctgggaggaaagcctgccccaggcccttgtgctggagcccagcagggagctggccgtacaggtgagccaggagatattcaggattggcaggaaaaaacggctgaaggtgccggccgtgttcggcggctttcccattgacaagcagatacagacactgcgccagaaaacccatatcgtggtgggcacccccggacgtgtcatggaccatgtgcgccggggaagccttaagctgaccggcgtcagatatctggtgattgatgaggcggacctgatgctggacatgggattcatggatgaggtcaggcagatagcggggctgcttcctgcaaagcggcagacccttctgttttcagccaccctggatgaggatgtgaagaatctggcagaggaaacagtcagggacggggtgtccattttcctggaacaggagggagaggccgcccttcccattgagcagtccgtgtacggcgtgccgcaggaccagaagtatacggcatttaaacgcattctcatgaaggagaatccggagcgctccatgatattctgcggaaccagggaaatggtccaggtattgtttcagaagctgagaagggacaggatattctgcggcatgattcacggcgatatggagcagaaggaacggcttaaaaatgtggatgccttcagacggggaggattccggtacctgattgccacggatgtggctgccaggggaattgattttgaagatgtcagcctggtggtgaactatgatttccccatgggaagggagacttatgtgcaccggattgggcggaccggaagaaacggcaggacaggcagggccgtcagccttgtgactgaggatgagatgaggaccctgcataaagtggaggcctacatgggagcatgcctgccggtccagccctgccctgagacaggggaagaggaggaaaaggcattctgggcccttcagagaaagaagccggattccgggtcccataagggggagaagctggaccagtccatcaccagactctccattggaggcggacgcaaatccaaaatgaggtccggggacattgtgggcgctgtgtgcggcatagagggcgtggatgccggtgacataggaatcattgacatcagggagagccttacctttgtggatatcatgaaccggaaaggcccccgggtcctggaaggacttcagaacaggaccattaaggggaaaatcaggaaggtgagaattacttcgcacggttaaattcctttattctcagactgtcgggaagatgcatcatatgatggcgcgtcagcggcagcaatatgagtcctgccactgtatggcggccccagaaattcctgagccatatggactgcctggcctccagcagaccgccttcgctgaccagccgtcccaggctctcttcgctgggtttccgtttcatatcaccgggggtcagggcatttaatatcctgcgtgtccggcaccccaccgcgtttcggtaatgtatcagctcctgcttgtttacctgccggctaaagccgatgatttcctcatccgtcatggcgttgccggtgtcctttacggaaacctgcagcctgtccatccagtcatcattgaatatttgggatgattctgctatgaggagattggcagtcaaatcttcgattcttgcaatgtgccacagatgccaggctatggtttcatctttttcagtgggcattacgctgtaatcctggtccgttaatccatccagtatctcgtcgcagtaggtgggaacagcgctggcggaaacaatgccggtgtgtgattccatggatgttaagggccagttcaatggcaggaccaaaattcctggttgattttatgagtttgcgcagctggtctatccgggtgttgtaatcgttttcaatgtctgtcatatctatagcctccttactgttattcaatgcatcattctgctaatcaatacatcatccagccatctggaattaattgtaaattcgggctgtttccggactatcatatatatcataacacttctaatatgacataaggctgtcatatttatttttttccgttttctgtccctgcgggccgtccatgggaaacagagataataggtgtagcaattgcaacatctgtggtatacacttctggcaagcggacgcatttccttttacaatcatgatacagggagaacgtaacaaataacaggcaatataaggaaatgtaaggaggaaaacgtaaatggtattacctcaattcgagtatctggctcctaagaccataggggaggcgtgcaatctgctccttgagcttggaagcacagccaaggtcatggcaggcgccacggacctgattccgccaatgaaagacaaggccatattaccagagtatatcattgaccttaagaaaattccaggtatggattatctggaatacgaccacagggaaggtttgaaaataggggcgctgacaaccctgcggaccattgagacatcgcctcttgtcaaagaaaaaaatccggcggtggcccatgctgccaaggtagtggcatccacacaaatcaggacaaagggcaccatggcaggcaatatctgcaatgcatccccatcctgtgattcagcccccaaccttctggctcagggagctaagatattggtccagggaccggataaggacagggtcattaaaatcgaagactttttcctgggcgtcaagaagacttccctggagcccggggaaatcgtaacaggcattgtgattccgcccctggccgggaacgagagggccgcatacataaaacacgctgtcagaaaggccatggacctggccatcattggcgttgcagtcaaaatcaaggtggaagacggcgtgtgcacagatgccaggattgccctgggcgcggttgcggccacgccgattcgggcgcccagggcagaggaagccctgattggaaaggcccttaccgatgaagtgattgtgaaggcatcggaggaagcaatgaattcctgtcatccaatttctgatatccgcgcgtcagccgaatacaggaaggatatgattcgcgtgtttacaaaacgtgccattaagcaggccatggaatgctcataagtggccgctgcacaaaatgcttataactaggagggagacgggaacatgaaaagctgacgttagataacgatacttttgaaaacactggaaaatcaaggtttttcgagcgacggacaagcagggtattgtactaaaaactgaatacgacgcagaagcggcgtttcttactctctacatgggagaacaggaacgccgcttttttcatgccctttgttacgcagtaggggcagaaaaagccttgctacaagcggttttccgggcgcgtatctggtgcggaaagggatttataccttatcccccgaaaccgcgcttctactgcgtaacaaatccaaagcaaaggagttatgaactatggcagttttcagagtggaacggaacaagggctacaccgtaatgagcaaccaccacctacgcaacaaggagctttccctaaaggcaaaggggctgttgtcgcaaatgctgtcactccccgaagattgggactacaccttgaaaggcttatcccttatcaaccgggagaagatagacgctatccgcgaagccattaaggagcttgaacgcgccgggtatatcgtccgttcaagggagcgcgacgagaaaggacgcttgcggggcgcggactatgtgatattcgagcagccgcagccgcctacgccggatttacctacattggaaaatccaacattggataatccaacacaggaaaaacctacattggaaaaacctacgttggaaaatccaacgcaattaaataaagatatacaaagaactgacttaccaaaaaaagaaaaaataattactgatgaacaaagtacccattccattcctatcctttcccctaacccctctccttgcagagaagcggctacgccgccggaacggaaaggaacggaagcggcagcacagagcgcagttgatatataccgggaaatcatcaaggacaatatcgactaccacattctcaaacaggacatgaagtttgacagtgacaggcttgacgagattgtagacctcatgcttgaaaccgtatgcaccgccagaaagcgggtacggattgcgggggacgactacccggcagagcttgtgaagtcaaagtttatgaaactggacggcgagcatatccgctttgtgcttgactgtatgcgggagaacacaacgaaaatccgcaacatcaagcaatatctgaaagcagcccttttcaacgccccgtccactatcggcaattattacacttcccttgtcgcccatgacatggcaagcggcgcactgtcaccgaagaagccgcagtacggcgacccggactattattcatgcaaaccgggcgaaagcctgtaaaacaacaaaaggaggattttattatggcacagaaaatgacaggagcattggtatttgacgagcgcaccgaccgttacgacattcgctttgacttaaacagctactatggcgggctgcattgtggagaatgttttgacgtattcgtgcggggcaagtggaagccgacccggattgagtacggcgacaactggtatcttgtgggtatcagagccgaggacttgaacgggctgcgggtgcgtatctgaccgccgccccataaagaaacgcgaaaggaggacgcgacaaattgcaggacgaagtaaacgaaaagaccatagccctttacatcaagaccgggaagctgaccgcccagacgctccaaaaggcaatgaaagccatactgtcaaagggaaaaaagcagctttccaaaccgccacagggcaagcagagcttaaagcagcttatgaagcagaacgcgggcgtttccaacattgagattaccgagggcaatatcaaagcctttgagagtacggcgaaaaagtacggtatcgactttgcgctgaaaaaggacgcgacggaaagcccgccccgctatctggttttcttcaaggggcgggacgcggacgtgctgaccgcagcctttaaggaattttccgcaaaaaagctgacacaggagaaaaagccctcaatccgaaagctgctctctaccctcaaagaagctgcacagggcagaaacgcggaacgggcaaaggtcaagaacaaggacagggaggtatcgctatgaagccggaaatcaagaagctgcttatcttaaatctcccgtatctgctctttgtctggctctttgataaagcgggcgcggctgtccggctctcccccggcgcggacgcaagcgcaaagctgctacatcttggggacggttttaccgccgccttttccagtatcgcgccgagcttccacccggcagacttagctttaggcattgcgggggcggtcattgttcggctgattatctacaccaaaggcaagaacgcgaagaaataccgccgcgggacagaatacggttcggcgcgttggggcggggctgacgatataaagccatacacagacccggtatttgagaataatatccccttaacgcagacggaacggctcaccatgaacagccgcccgaagcagccgaaatacgcaagaaacaaaaatatccttgtaatcggcggttccggcagcggcaagacccggttctttgtgaaaccgtcgctcatgcaatgtacgtcaaaggattttccaacgtcgtatatcgtcactgacccgaaaggaacactgattttggaaaccggaaaaatgttgcagcggtacaaataccgtatcaaagtgctaaatacgattaacttcaaaaaatccatgaaatacaacccctttgcctatctgcggagcgaaaaggacattttgaagttagtcaataccattatcgccaacaccaaaggcgacggggaaaaatccggcgaggatttctgggtgaaagcggaaaagctctactataccgcactaatcggctatatctggtatgaagccccggaggacgagaagaacttcacgacgctgcttgaaatgataaatgcgtcggaagcccgcgaggacgacgaggacttccagaacccggttgacctcatgtttgaacgtctggaagaaaaagacccggaacattttgcagtcaagcagtacaaaaaatacaaacttgcggcgggcaagaccgcaaaaagcatacttatctcatgcggcgcgaggttagccccattcgacattaaggagctgcgggagcttatggaaaccgacgaaatggagcttgacaccataggcgacagaaagaccgcccttttcgtgattatcagcgacaccgacgacacctttaactttgtcgtgagtattctctacacacagctattcaacctcttgtgcgacaaagcagatgatgaatacggcgggcggcttcccgtccatgtaaggtgcttacttgatgaatttgcgaatatcgggcagataccgaagtttgaaaagctcattgcaacgatacggagccgggaaatatccgcgtcaatcatcttgcagagccagtcacagctaaaggcaatctacaaggacaacgccgataccatagtcggcaactgcgacaccacgcttttcttgggtggcaaggaaaaaacgacgctcaaagaaatatcggagattttaggcaaggaaacgatagacagcttcaacacgtccgaaacaagggggcgggagctttcgcatgggctgaactatcagaaattgggaaagcagcttatgacggaagatgaaatcgcagtcatggacggagggaaatgtatcttgcagctacgcggggtgcgcccgttcttttcggacaaattcgacataacgaagcacccgaaatacaagtacctgtccgacgcagacccgaagaacgcctttgacatggaaaagcaccttaaacgccgccccgccattgtcaagcccgacgaggtttttgactattacgagattgacgcggcagacttacaggaggacgcagaccatgaggaaacgtagcgcagaggaaaaacaaaagcagcttgaacggtttttaatgaatgttgcggaagccgccgacgctgcattatgggagtattggcgggaaaaggaagcggaacaccgccgttttgcaacggagtatgtcacgcgccggggggcttatcccgcaacagtgacagcatggcagaccgccgggggacaggggaagctacacttcccctacgctgccttgcggcagctacccctttgtgaacttgcgggaagcgaacaccttgctacgcaagctattcacttcccgcaagtctgaaaaaaacgtccggcagcacagcgggacacagaaaggagcgattgaagcaatcacatctatccataccggctacatgatacgcgcccccactttccggcgcagtacacagcggcaggagccgcaccccctacaactgaataccgccgcgccgcagaacttacgcagcgcggggacagccgcctttaccagagggcggtttttttgtgcggcggcatatgctgaccgccttttgtccgcttgccggacagccgcagacgcggcagaaaggatatatttatggcatttttcaatagcgcagtagacgttttgcagacccttgttgtagcacttggagccgggcttggtatctggggcgtaatcaatctgatggagggctacggcaacgacaatcgtgcgacacgttcgtaactgaaaaggttacgcactaagtcgaaaggctaaatagcctgaaatcttaggagaactgacaatccgatgggtggaatgatagggtaacgccttgaaacgcccacactgatactccgattggcggcggtatgcaactgcctaaccgtcaaaagctcggtgaagtcggcagagagtgaccgtaagcgggatttttttaccgcacgaaacctgtccagaggtggacggcgtcacctatatgccgggtgtcggatactcatggtgagaatgtatgaaaatactggcgtacttccgaatgtacgggtctaaacgtttggatttgtcgaaaggcatttccccattaaattggggtgtccgtggattagtaagattggttgttatgaacgtccacataccgttacaggcggtaagattctttgaattggacacaggcttagaggaagcgcctaaaagtattcaatgataggattgttggaacgtggtaaaccgggacgtgaatgataaggctgttgcaggctgatgtcacgctgataaggaaaagcgaaaaccagcagggaatgctggtatatcagttatgatattccactatcgctataacttatcttaattctggcgaaagtggtggcacagtacctatgaagcgggaataaaaagcccgtggagggatagccaccagtcggatttagaaacaaaaactgaaaacataacaaacacagcttcgagtatgacaaagaaaatcctaaccgaaaggggtgggtgcctgtgttgacttcggagcagcaaaagcacaaaccaaaacaaagcaaaatccgctatacggagtattacgacctgcaaagcatctttgacagtctgtatgctgacagcctgaacggcaagacctttcagaacctcatgcgcctgattgcaagtgaggaaaacatcaaactggcatatcggacaattaagggcaacaaaggaagcggtactcccggcgtggataagcggacaatcaaagaccttgccgcacttcgtgaggaacaatacgtccgtcttattcaaaaacagttcagttggtacactccccgcccggtgaaacgggtggaaatccccaaacccaacggaaaaacaagaccgctggggattcctacaattgttgaccgcatagtgcagcaatgtattttacaagtgcttgaaccaatctgtgaagcaaagttccatgagcgttccaacggcttccgtccgaaccgctctacggaacacgccatagcacaatgctgtcggctcatgcaggtacagcacttgcattatgcggtggatattgatattcgtggtttctttgataatgtaagccacggcaagctgataaggcagatgtgggaaatgggtatccgggacaaaaagctgttgtgtatcgtcaagcagatgttaaaggcacaggtggtacttccagatggaatgaggacaactccaaccaaaggaacgccgcagggcggcattttgtcgccactgctctccaacatagtgctgaatgagcttgactggtgggtgacttcccagtgggaggaaatgcctacccattacgagtacaaaacccggcagaacgcccacggtacagatattaaaagtcacacctaccgggcgctcaggcggagcagactcaaagaaatgtacatcgtgaggtacgctgacgacttcaaaatcttttgccggagccggcaggacgctgaaaaggcgtttgaagcaacggggctatggttaaaagaccggctcgggctggaaatcagcccggaaaagtctaaagtcatcaatctaaaacagcggtattcggagtttttgggatttaagatgaaagtctgtcccaaagggaaaaaatacgtggtctgttcacacatgagcgataaagccataaagcaggcaaagggaaaaatatctgccgctatccgggcgatacagaatccggcagatgaccgggcgcaatacatcgccattcagcaatacaattccgtggttgccggactgcacaattattaccgtctggcaacacacatcagcgtagattttccaaagctgtcctatggactgaaactgcaaatggcaaacagactgcgggaattgacatcaaaaggaaaactggaacgtggatttatcaaggaacggtatggcaagagtaaacagctaaggtttctaaacggacaccctctcattccaatgggatatgtccaaacaagaaacgcccagcacaaaaagaaaaccgtcaatcggtatacatcggagggacgggcagaaatccataaaaatcttggtatcaataccgatacgatgatatggctcatgcaaaaccctgtgttggataaaacgattgagtttgcagacaatcggatttcgctgtttgcggctcaatatgggaggtgtgccgtaactggcattgaccttatgcctcatgacattcgctgtcaccataaagtgccgcttgaaaacggcggtacagatgaatatggcaaccttgttcttgtaaccgaagcagtacatatcttaatccatgccactttgggagaaacaatccagaagtacctaaatgaactccaactgaacaaaaagcaactggaaaaactgaatagactgcgaaaactggcgggaacgtctgtaatcgcataaccaatcttttaatgctgtaacgaagtgtgtaagttatgtttaaaacgtaaaatttctaaattcgatggggcgccgtgtgcggtgaaagtcgcatgcacggtgctaagcgggggaaaagccggaaacatttgaaactgtaggcttacctatcgcaatcgggcgcgaaaagccagggcatgaagcaggttatggctaattagatgtaaataaaagcggaaaggaaaagcacaatccagacggaaccggcgagccgtcaagaaatattgcgagttagcaagaaaactgctataatgggaagcacgaaccccagcactgggagaaaggcaggacgataaatgcacataagctatcaaccgctttggaatacattgaaagagcggaacatgagaaaagaggacttgcggcttgccgcaggactcaccacaaaccagattgccaatatgggaaagggattgcatatcagcatggaaaccctgcttcgtatctgcggggcgttggattgtgatatttcagatgtgattgaactggaacgagaaaaatcttcttctggtgaagcagaagatagaatcaaaaagtcgaaaattccttgctgaagaatagcaatattccaacattgaaaatataacaaagttaggacgtggaggataaatgtacaaagtattttcatttacaaacaccgatgaagctgctccttatatggataaaaagattcttcggtatattgatgaacagattacggacagttttgagtgttttaaggactgcgatatccttgcatttgactggtacgatgttcagagtgaaaaaaaagaggattttaagatgctcttatatctggacggaaaggatttgctggtattttgtgaaacctctgaggcagaagaaaaagcaaatatgattctgcatacgatgacaggggaagaaggagcaacaaatgagcggcttttctaccattttttttcgttactgctgaaaggagacatggattttttgaataatcttgaggaagaaatcagcaataatgaagacaaggtgctgtccggcgacaaggcatcctatttgaaatacattactgcatggaggcaggaactgttgcgcctgaaacgctactatgagcagcttaatttcatttttgatgaaatgaccgtgaatgacaaccaactatttagcgaagacggagtccgcagattgatgactttgaggaatagaacggaccgttacctgagtgccgttaagaatttgcaggaaatggtgtcccagctccgggaagcatatcaatcccagctggcgattgagcagaatgatctgatgaaaatttttacagtggtgacagtaatatttctcccgctttcgcttctggcagggtggtacgggatgaatttttcacatataccggaactcaaatggaaatatggatatccattggtaattctggtgagcattgtgacagtcgcagcgttaatttggaaattcaaaaagaaaaaatggttatgattcgctttttaagaggacacaaaaagttcacaaaaaaattagcactcaccattgacaaatgctaacaagcgcgctataacacagatagaacaaaggaaagggaaacggaacagatgagaggttccgatttcttcccaagtattcttggttctgattgacaattcggttttaacattaaaaaaggagcgatgacttatgatgttacctagtgtttttggtgaaaacttatttgatgatgtttttgatgatttttgggggttcccgtcatttgatgataaagcagagcggaagttatacgggcaccatgcagcaaaaatgatgaagacggatgtgcaggagcacgatgaccattatgaggtggatattgacctgcctggtttcaagaaggatgagattactctggaactgaaggacggctatctggtaatcagcgccgcaaagggccttgacaaggatgagaaggaaaaagaaacaggcaaatttgtacgtcaggaacgttatgcaggcagtatgagccgttctttctacatcggcgagaatgtgaaagaggacgatatccatgcaaaatatgaaagcggggtattgaagattaacattccaaaagaagaagcgaaagaaccggaagctgaaaaaaagaaatacattgccatcgagggataacggcacctcttaacatagaataaaaggatattgcccggagcgggaagctgtgaagttgcccgttctgggcttttctatatcatttaaacaaaaaacaattcagccagccggaaccggctggctgtcctactgttcattatgctccaacaccgcttttatcatagcaacggcaagctcctgtttgctgggcgacacgtctttccagagtgcttccagctccttgattttgctgatttcgttttcttccaattcatcttgaagcagataatcaggggaaatccgcagggagttacaaatatctatgaataccggcagactgggcattttcacaccgccctcaatctggcgaagatacgttgcgttgatattgcataattccgagagcttgtctgcggtaaagccccggtcttttcgtacctcattgatacgctttcctaatccttttctctccattgccaccacccgtttgttagctgtcagttattattttgtacaccataagcctataatatgattgtcatttatcatagattctgttagactatgttatattagctaatagctaaacggagggcatgagatgaaaagaatgtgggaaaaagtaaaggaaacatggcgggaattttggttcgtttatgaggacgaggaagattccacacaacacctaagccggtcagataagcaaagtatctggtgcggctcatttcttatgtgtgcgttcacggcggttctatgtatggctggaattgcaatcgggaatatccgtaacaaccgccagtatgagcaggacgtggaagaaacactaaatatgatagcaacctactttgccaccgccaccgaggacgagtatgacgagatagcccagactatccgccatgatttggtattcagtgaatacggcagggatatggagaatttgatacagtacattccgaacacgtccgagagctgccccacctgccaggaaagctatccggcacaggcatttcttgtttgtgtcaatacaggagaaacctattcccttgacgtgtatcacacagacgaaagcccggatgatgaatacggcggtatgcgcctgtcctttggttatgatgaaatcagcgaagcgagtattcatgtaacatcatatccgggagaacaagacggctatgcagagattttccgggggcggcggattgtcagcgcccacaagatgaagtctgttttttgtgacgattgtatcagggagattctaaacacgattgacgggcagctattggaggaagttgttctttttgacgcagaacaaaaagccttttatccggtcaaggacgaggaaacgcttcaaatcggaagctatgggctggctgtcagctatgacagcggggatttcaggattgatatagaatatgtcagcgaataaaggcgctgccgttgcaggaaccgcaattccaacaacggcagtttttattttctcctgcgccggaaattcaaaggattgtttttaatgaccggcgattttgccagcacttttttcaagactttctgctcatcagggggcagcttgtcaaagtcgatacccagcatatttaaaatgactttccagatttttgtcaggtggtcgccggggaatttcagggcgttttgaatatcttgcgccattttctttgcgagggagaaatccggcgtgctgtcaatgtcgtgttcatgggctttccgtatatcgtggagaatggaatcccatgttttatgcgttatatggcagaaaaaatcttcttcctctaattgggcggcaagaagcgtttccgaatataaatccccgtccacatagcggtgcttctgaatgagggcaagccgctgttcttccagcccttcgttcatatcccggaagcgggcggtcgcatgaccgtctatgtaaatttccgtatcggtcatcagccgctcaaactttccgtgggtgataatctcacagagcagacggttattgattttgccgcttttcaaaagctccactgtttcatcattcaggtgcagctccattaagggcgtgtttacctgctccctgttttctgtccggcacagcaggtaatcaagggacaccccgtagaagtccgccagaataacgaggttgccatgattgatttctttgtaatcgtccgcttcatagctgccaagggcagactttgaaatgccggtcaggtttgatagttcttccagcttcagctttctctctgtgcgtaaatcctttagccgttcctgtatgctaaggcgtgatttcataggcgaatggctcctttccggcggctcccccgccgctctctaaagattataccacaccatttccgagaacgtggaaattttcgattttcagctggatttcctactttatggatatacggagcagggtacaaaaatgttctatcatacaagtagttcatcggtgaatcaattcaaccgaatgaccggcttgtgtgggatatgcgccccggagatgtagcgccgtgacctgcggcagggaaatggaggaaccctgaccgcagcgagcgtaccaaggggagcgaaacgccgccgtgagaatcgggggcaggaacgacaccggggagaaccggcaaaatggacaccaaaacgataccaaaaaccaacaatcgggcaaggtatagcctaccctgcccgtaataccacgggggattttcgggcggctctatggcttgaatttccctgaaaatcgccccgaaatgcaacacaaaaatctgctatccgtccaccggcggctgttaccgccagcatgggcggatttttcattaaggaggcactatgccgagaatgtcaaagaagttgaagaaagagcttgctttcttcttaaacgagcgtggacgcaggagctacaacgagctttgccggaaatgccagcatgattgcaagcagagcttccgggcggtcattgtggcttgcccccgctatctttccaaacgctcaaaacagaaaaaggaggacaccaactgaatggaatatgaatttatgacgattgacacacccctgccgcccagtatgcctctgccgagagccatgctgcggctcccgatcagcagcaccgcaaaaatcatgtacgcccgtatgctggacgatgttctggcaaatggcatagaggacatgaacgggattttatttatctgtttcccgattgtggaattgtcggcggcgctctcccgcagcaccatgaccgtgaagcgttccttaaacgagctggaagctgccggactgattgtgcgggtgcgtcaaggctttggggagccgaacaagatatatgtactcattcccagaacggagggctgacgctatgagtgaaaagctggaaaaactcaatcaggaaatagagaaaaccgaagcaaagttgcggagggcgcagcatgaggaaaagattctggaacaccagataaagacgctgacccgaaaagagcggacgcaccggctctgtaccagaggggcggagttggaaagatacctgccccacccggagcttttgccggaggaacaggtcaaactgttcttgaagctgctctttcatcgggacagcacccggcagctcatagaacagatatttgccggaaccggcacagaaaaggaggacacggaatgaatgtgaaattttcaaaggacgagctggctatggtttaccagtacgccgccgccacgaaacaggaaactcttgccggacttcgggaaatcgtgccggtcattcgtgacaggcaggcgagggagattgtggaaagcacaattcgaaagctggacgctatcccggagccggagtgccgccgctttatcgctgacaccagacagcggtttatccagaagcgggacaattcaatccggcgcaggctggcggaagcaaaggcgcagacgagggagaaaacgccccattccaagagaaaagagccagaccgggaacggtcataatagcttccagagcggtaagcgtggcttccccctctgaaagagggcgcaactatacaccggtcgagccggtgcgttgcgtcctgccggaagccccttgcagggagcagatgatttccgcagattttcaatctgttccaatcatcacaggggaagctacacttcccctgcgctggctgccgccagctacccctttgtggacttgccgcccgggaacaccttgcgttgcaagctgttcccgtccagcaagtttacaattcctctattcctaatagtggccggttatggtataataaagtcaacgacaaattctttaggttagaatcaatgatggggtaaacgaaaaagcagttttggcgttttttgcattttttcaagtgtgccataaaactcatcagaaagaaaggcggatgttttgacgtttacatttgacgcttacgtattgactccataacataaaaaataattccatataagtaaagggtgccagataattaacatccggcgcccttttaactatttgcctctgcaaactgaaatttgtcaatttaatcgttgtggtttagatactttatatattcactttgacttccgtcccaataacaatatatacatctcccatttttgaaagtatggatacaattttggtagccatacagaacatgcgtacatttagggcacaacgccgccattttagaacttgattttataaattcacttccacattcgtcacaaatagaaacagcatcttctcccacttcaaatgctcgaaccgactttgctagaatatttaaaaccaaatcatcattcgcattaaaaaaagcccgcttcaagtataattccaattttccaagcataagtttgtaattcgtttttgaccatataaacttttctataaacaacacctcctacgcagattcaaatttttctacccgacaacctgggagttgacattcctaaaggcttttgtgcagagtgttacctcttttattcgttatagcacctcaacaacttcaaaacgctcaaacgtaataggtgtttgattggtaaaagtataaccgcgcctggcagcgtctcgtgtccaataacgtatattgcccgacttccattgttcaaagttttcgtcctcaccctcaagtttgaccatattccaggttaaatcgcaaaacttgaccgtatcaagatacaccgtctttatcacacaggctggattgccgcgcccatcgagtacaagcgataaatcgccaacacttggggtctgttcgtcctccaatacaacggagactgttgcagttttctttccggtaagtaccagcgccaaaagttcatccgccatttcgggactatcgccaaaagcaaagcattcaaaatagcttttatttgtattttctatcgaatccatttcttatttaatctccctaaaattcaaattttctacctatcaaactgggatttgagcatttagcacctttaatgcttaaattccgtaattaatgtcctatataacataactaatgatatactcaataatattccaccaataatatcggtcatccaatgaacccctgatatggttcttcctaccaccataaataatgtgaacaccgaaatcactaaaactattatatttttaactactacacttttaatgcgattttttaactgaaggattgctgtcggcattacacaaagtattaacaacgttgttgatgatggataagaagactctagcctgccttcgatgataactggtctataattaatagcaaactcttcaaaaaccacatacccaattattacaagaatataaaagaccccaagtattattatatctgaatctaccttgaacaaatttctacgtcttatcaattgaattaatcctaatactccaaatccaagtacaaatacaatagcaacaagccctaaccaatctgtaacctcataaagccacaaatgcaccccagtcattttatggaatgcatcatttaatgttgcaaatccaacaacagttcctcttggtccaattgcttgcaaatcaatttttgtgattgccaccgtccataatacaaatgcaataaaagcagttaaagtgattcgtacatttttctttgttttcattttgttacttccttttcgtttttattttggctcagcacctaaactaacactaacaaaagaagttaaaaaacaaaagaattgctttgtcacatacaagatacgattcgtgtcattcccattttatcagcattatcgcctttataatcaagaaaagtaatgtgaatccagcagcatatggctgcgtactcatgataaagaaaaaagctaataccgtacttagtatcaatgataatttagaattattcttaacccatatcaccttattgcagttctgtaacgccaatgtaaatattcctaaaactacaatagcaacaattccaattatataagggacttttatatatgaattaacttcgataaaatttaaaagtgaaacctcctgtatcacaccatttatgttctgtccaaaaaaaggcaagaagaaaaacataatcaaactgcaatccaatgtcccataaataatatctctatttttctgttcctttactttctgctcgttttcggccacgtccagcagttcctcattggaaagcaactcatccaatgatacggaaaaatatttcgagattaccttcaaagaatcaatattcggatagccttttccagactcccattttgaaattgcggttcttgatacatataaatcgtttgcaagttcttcttgcgtcagtcctctattctttctaagttcttttaatttttcactaaattccaagtattttactcctttacaacttccaatttttctgcccgataagcttgaagttgtcactccaaaatcaacggtagcataatcattatggctcctaacagagcaaacaaaataccgccaaattttgtactttttaaatagatgtcagacggttcatctgcacgataagatttccattcttctgttaatttccaaaccaaatgtggcttcaaaaagataaacattcctaacccaaggaatattattccgccacaaacacactccaacacattcacacgctcctttacaaattcatatttttagttctacaacctggaagttgtcggtattaaagcgccattattttatccactatttcacgaacggttttattgcttgtttcaatttttatcgtatcaagaacttgatacatagaaattcttgcaacacttctatcaataacatcagcggtgcgaacctctcgtgccacatctgcccttaatctgttttgcagattcatttcatcgacagtcagtgagattatcttaaccatgcaattttctgtatcaagttcgtttaaaatgctgtcaataatagattgctcgtgcattacccaacaaaaaatgacattttcataaacagaacagtgaataaaactattcagcaaataacaaatattgcgtactaccatcgctttagtttcatcggtcacttgaaatggactggcatcccaacaccaatcaccatcaaggaatacgcttttattcaaatctctttttaactgttggcttactgttgttttgccaactcccatcgttccgccaattaaataaagtgttttcatagatagcctcacaaattcaaatttttctacccgacaagctgggatttaatgcatggcataatttatctttaccatgtggatatggtcttcccaaacgccattgatatttaaataatatcttgaaattccctcgttgataaaattatttttttccaacacgcttaaagaggctttatttttcggcatcacatttgcttctattcgatgtaagcccaattcttcaaaggcatattttgtcaacatttctaccgcaatagacatatatcccttgttgacaaaatccttgtctaatttatatcccaggaaagcagaacaaaaggctccccataccacgttgttcaatccaatgatacctataacttttacgggttgttccacaggcataatataaaagcgaaaagatgttctttcctcatattcagacatttccttttttaatactgcctgctgatattcgagagagaaaaactcctcgtttcgtgtaggctcaaaggcttctaaaaacgtccggtttctcttataataatcaaccacttgttccgcaagagatatatttgttggaacaagctgtatatattggtttttcatgatacattcacctctgcaacttccaatttttctacctgacaagctggaattcgctttgttcaacctcaaaactacccattgggcacgactgtctgccatagcattatctagcgtgtttatccatttgtggttcataaaaactgcagccactttttccgtttctttttgtttcatacaacgcacaatccgcatgatgaaacagttcctttgaatatccatgtgtagaaaaagcgactcctactgataatgatacgggcggcagcttatcaatcgggtttttcaatctatcgtttatctgtttgatttttcttgttatgaagtctttcttatcgtatgttaaattattcaatattatggcaaactcatctcctccgattctggacacgatatcagatgaacggaatgaactgcttagaatctttgacgttttaaatagtattttatctccgatttcatgtccataggtatcattaacggatttgaaagaatccacatccacaagagcaaaggccagcggaaactgctcattttcaagaagatacgtcacgttatcaaagccgcttctatttagaacgccagtcagagcatcgtgttctgctttatacttcatcacctctcctgcacgcaaagattcaaacaaattatcattgagttcacttgccaattctttattgaaaataagcccatacactcgccctagcttgattaacgcctctttttcctcttcagaccatatatgctttttgaattgctgaaaaccaatggaaccatcatatatctgattattgcatcggacatatccataatggagtacattatctgaaatggcatactgctctgaatccttaacattataaccacatacacgctgattatcgtacatatggattgcatcttcatatgcgtccggaggaagctgaattacctgtcctaccgtattatattctggtttactaacactcataaatcgaaatacaaattctctttcaagagaaatcttctctagtgtatacacaacatctaactgaaaactctccctgatattattcaataattcctgaaatgcacttccatttagtttatcctcttccatcaatgtactcataaatttctttataaactcgtctattctagtcaccataagctctccccccaattcatgtttccatctcggcaaattccaattcaaaaacttgaccaacaaggatttgacttacagtcagattgaccaatcaccatagctgaaagttccgctaccatgatgaagttgtccgcctgtcttgagttttctaaaagcgtctcgtatacgaattacaatttccggttgaatggcaagcgaatgatgtacggggaatatccgctttgcatgtaattttgcaatcttttcaagcgattgcaaataggcattggggtcagtggacggaaaccacgctgttagtgtgtctttgttaaccaaatcacccgtattgagatagcccttttcttttccccaaaagcacatatgccctggcgcgtgtccgggcgtatgcaatacatcaatcttcctaccgccaatatctatacattcattaccatacaatattttagtaggtattccttgaaaaaggtcgtacgtatttacatcatagccgtctggcaaattacaacggtcaaccacattactcctttattgtttctaacggttgcggaaaaccgccagtaagccactcaagctctgcctcgtgtgcataaaaatcgggaactatactattccttataaatgttttttccaaaatcgtaggcctctataagatggtttgttttatcaatttgtggttttccatttgtgtcaccacatccaccagcaagtagcatccctttatcattaaaaccaatataatttatgattgcaaatttgtaatacgatactgcttgttcatatgtccaaaagaaattgtcggctgatgtcatcaataaagcagcatcttttattggatatctttcatatcttcctaaaggcggattagaatcttcttctgcgatacaataaaatctctcaataaatgccttgattttagaagatagtgtccaaaataataatggagatgcaaacacaattaaatctgcagatttaattttaggtacaagttcattgaatccatccttttgcacacaaggttttccataacgacaagcattacaaccaatacaacctttcacttccgttttattaaggggaattttttctacagaatgtccagcttcttttgcccctcgaataaaagcgtctaccaattgactggtattaccattagctcgtcctccaccttgtataactaatatattcttcattttttatatttcctcatcaacttcaaatttttctgcccaacaagttggaagttgtgcaatatcgctctatccattttctaccattctgtagtcataaaccgttgaagtttttcttgtatattgtcagttccttttatacctatcatcggaatagaaattttttcttgtaaaagctggtaagaaattctttctacaaacagtcccattccattgatttctgcattgttgtcagatgttgtttctacaccacaatttggagaacgatttgctccaataatgccaataatttcaaatccatattttttatattctatgatttgttgtactacataatcagccagccttgttagttttgcattcgagctgtcacttttcattgccgaacgtattcgtgtattctctaccactacaggactatcaacgccatgaatattccccctatcaagtcctaagcagcaaaactctgggcagggcatttggataataccaatattagcatttaagaaaaaatctataacatctctaaatactgccggataaaccgccgttccatcagaaatagagttttgatttaaaaagcaatgtgcgataaaaataacttttttacttcttccatcattaaacatattacatcctcacaaaattccaatttaaaagcttgacaaacaaggatttgacatttcaattaaaactgtccataatgattctccttgaaaacaccttcatcgcagcttcaaactttccagcaccaccaacctatcgtttttcggggtcattcgagccgctgcaaaattttttattcaagtatagctgaaacacgttgtttaggcctatgtatccttttgtaatgtgatgtcgtaaagtcacataggacaaggagcttctaaaacgccgccatcatatttgaaattatataaagcaactgccgtattacactccaaaaaacggcagctcgccaagccttttactttatcctggaacaattcacaatcagaaaatccgtcaaataatttttcaaaatcctttgtgtcgtagtccaggacgcacgcttctcgaaaatcttcatcaaatgataatccaaaatcgtattcaaattgattaaaaaactcataattaaacagttccttccgttcattttcacaatctctatgccgattggcaggaataaacagattcttccatatatcactctgttctgctctttccatgtccccattaaagtcatcgtcaaaatataccgttgacaggtattcatcaaccatattgtaatttttacatttacctatccaaagcgaaacatacccctccttttcactgtaatcataaatcataagtcagtctcctttactactttgatttgttttccagcattttatatagacgcacaaaaagattatcccgacttttagaggaactggagataaccactgtttttatgcctatattctaccataaagccaatcccccgtctatctcattgcctgccagtcatgttttccttcataatagtcttatgaatatactacaaacgatttttactgaccatttcgaagaaatgatttatctccaacaccctcgtgactctgttatcgagaatgtagaaaaaatgattctctgcggtaatcctgcctttggtggtgccatgtatacctgtcctttctgtgggaatttcaaatatgttccttttcgatgccattcccgcttctgcccttcctgcggtaacatgtattccattgacaagactacttctatgtcctttaaaatcattgatgtcccgcaccggcactgcgtctttacaatcgcctgtgaactacgcccccttttccttcaagaccgtactcttttaaactgcctgttttcttctgtcaacagcgtcatcactcgcttgtttcataaagataataaatcagaacgttttactcccggcttcatttgtgtcctccatacttttggcagggatttgaaatggaatcctcatatccattgcttagtctcgaaaggctgcgttggtacctcgctcctgtggcgtcacaaaacgcactttaattacaagctcgcatacaatctattcaaaatcctccggaagggatgacctctgatgaagttcatgacatgagtgatgaggaccttttggatatggataactttttacagtaaaaaaagacccaaagcatgcaaaaaacatactttaggtctctattttttctttttatttcccaaaaacggtctgttttacgggagaatcagtcgatttccaatgggagaacaacaacagattacattcccatctgcttagctacctcagcagcaaagtcttcgttcttcttctctaaaccttcgccggtctcgaaacgtacgaacttctttaccttgatggaagcgccgttagccttagccacagatgcaacgtactgtgcaacgctctgcttgccgtcttctgcctttacatatacctggtctaacagacaggtttccttcagctctttgttgatacggccctttaccattccctcgataatcttatcattggcatccggcttctcattcttagctgcagcggtaaggatttcagtctcctttgcaatgtaatcagcgcttacttcgtctctgctggtgaacattggctttaaggctgctgcctgcatagccacgttcttagccatatccttgatatcgtcattgacaacatcggtctctacgtctaccagtacgccaatctttccgcctgcatggatataggatgcaacaaagccgtttgcctccacaacctgctcaaagcggcggatgttcatgttctcgccgatgattgcaatctgggaagcaagagcttcctttacggacaatgactcgtccttagcccatctctcctccatgaatgcatctaagtccttagcggaagtggcaagtgcctgtgctgcaacgtctgcaacataggtctggaacttctcgttcttggcaacaaagtcagtctcagcgttaacctctacgataacagccttcttctcatcatcagctaatgcggtagctacgatgccttcagctgcaatacgtccggccttcttggctgctccggcaagacctttttcccttaagaactctactgccttatccatatcgccgtcagtagctgcaagagctttcttacagtccatcattccggcaccggtcatctctcttaactcttttaccattgctgcggttactgctgccatttcatcttcctccaattttaaagttttaattaagcctcaacagcctctgtctcgaaagcctgggcaggaatctcgatttccattgcgccctctaaaacttcaccctgctttgcctcgatgacagcatcagccatcttggaaacaatcagcttaacggctctgatggcatcatcattgccaggaattacataatccagttcttccgggtcacagttagtatcaacaataccgattaacggtatacccagtgtgtgagcttcctgtacgcagatgtgctccttctttgggtcaacgatgaagattgcatcaggcagtctcttcatatccttgattccgccaaggtttctctctaacttgtcccactccttcttcagggcgattacttccttcttaggaagaacatcgaaggttccgtcctgagacatggtctcgatttctttcagtctgtcgatacggctctggatggtcttgaagttggtcagcatgccgcccagccatctctcgtttacatagtacattccgcagcgctctgcctcagccttgatggcttcctgggcctgcttcttggtgcctacgaacaggatggtgccgccgtctgcggcaatgtcggatacggccttgtaagcctcatctaccttgcctacggacttctgtaagtcaatgatatagataccgtttctctcggtatagatgtatggagccatcttagggttccatctccttgtctggtgaccgaaatgtacaccagcttccagtaactgcttcatagaaattacgctcatgttatttacctccatttggtttttagcctgctccgtcgcgtatgggagttcagactcttccgcctgcttctgacacttcccggaagacctgccaaactactggtcaggcaccgtcccgcagaatccacagacgtgttttttgtcagcctttcaaatatatcacaaaatatggcagcttgcaagcacttttaataagttttcctgcaaactgccctatatattatctgacattatctatacggctgctttccggccgtcccttagctgtttcagatttacctatttcagatttgagttggacgccttgattgtcttcagctcgtcaaacaccacgtcattcaggaccttgatataggttcccttcatgcccgaggagcgggattcaatgacaccggcgctttcaaacttgcggagcgcattgacaatcacggaacgggtaatgcccacgcggtcggcaatcttactggctaccagaataccctcgtttccgtccagttcctcaaagatgtggatgatggcctccagttcggagaaggacaatgtgctgatggctgattttacaatctgcacctttcttgtctcctctgcattctcctcattgacagaacgcatcatctccaggcccaccacagtggttccgtattcacttaaaatgatatcgtcgatatcatactgggaatcagacttgtagatgaagagcgtgcccagtctctctcccgctatatcaataggggtaatgatggcctggtacttcttcacattctcctcagcaaagccaagggtggcgaggtttacgttctccttggtggacaatacgcttaaaagacgttcgttcagcatcttatccacgtaaccgccgacctggtcttcgatgagttcctctatctcatctactccaggacagatgctcacccccaggaccttgccctttttgctgattaccaggatattggataacaatatctcacttagtactttacagatgtcattaaaaacaactttatgagaattattgttatgcaatagcttgttgatttttcttgttttgtccaacaattgaacactcatctccgaaaacctccttatccaaattgtatatcgcccaaaaatactctaccaataatagaattttaacacaatttttaagcaataacaagagttttttgaagttttcgattattttaagattttgataattttcctttttgtatttacaaatttttctatttttcagccttatccatacggtagccgcaggtctcgctggcgcataaaagcttatttcccttctctaccatataagaaccgcagaccggacatttctgggtggaaggtttctgccaggacataaaatcgcagtcaggactggcctcacaaccatagtaaaggcgtcccttctttgtctttcttcgcaccagctccttgccgcactttggacagggaatcccgattttctcaaggtagggcttggtgttcttacactccgggaatccggggcatgccaggaacttgccgtgaggtccgtacttaatcaccatctggcgtccgcacaggtcgcagaccacatcggatacctcatccgcaatctttacggactccagctccttttcagcagttttaaccgcctcgtccaggtcaggatagaagttgctgacaaccgtcttccaggcaacggtaccgtctgccaccttatccagaagggattccatattggctgtaaagttggggtccacaatgcttgggaaggaattcttcatgatgcggtttaccacatctcccagctccgtcacgtacaggtttttattttccttcaccacgtatcttctggcaatgatggtggttatggtgggcgcataggtacttggacggcctatgccctgctcctccagcgcctttaccagggatgcctccgtataatgggccggcggctgggtgaaatgctggcttgggtccagctgttccagcttaaggatggttcccttttccaggttgccaagcacctgatttttttcttcttcatcatctgcttccacataaacggacatgaagccttcaaaatccagcttggatgccgatgtggtgaacagatggctgcctgctcctatcttcacagaagtggtttcatatacagccggcgccatacggctggctgtaaagcgtttccaaatcagctggtacaggcggaacaggtctctctgaagcgattcttttacaatggtgggagtcaatgttatgtccgtgggacggatggcctcatgggcgtcctgtatcttaacgccctccttcttggcctggcttccctgagcaacatagttctcgccgtaatgctcttttacaaatgccctggctgctgtgtcggcttcgtctgcgattctggtggaatccgtacgcaggtaggtgataagacccagggtccccttgccttttacctccacgccttcatagagctgctgggccagacgcatggtcttttgggtggaaaagttaagtaccttggaggcttcctgctgcagggtactggttgtaaatgggataggtgccttctttacccgctcccctctctttacttcctccacctcgtagccgcatccctccaactggcccagaatctggtccagttcctccttgttacggatgactgccttgccgcccttggaatccctggtcccataatactttgcaaccaggggcttcttacttcccttcatgagaaggtctgcctccagattccagtattcctcaggaatgaatgcattgatttcatcctcacggtcgcaaatcatgcgaagggcaacagactgcacgcggcctgcgcttaatcccctcttgacctttgcccataaaagagggctgatccggtaacccaccatacggtccagcatccttcttgtctgctgggcgttcaccaggttcatatcaagctccctgggggtcttaaaggatgtctttaccgcgttctttgtaatctcattaaagctgatacggtacacatccttgctcttaagctcatccagcttaagcgccttcatcaggtgccatgaaatggcctctccctcacggtcagggtccgttgccagataaatcttgtctgccttctttacttccttgcgcagcttggccagaacatctccctttcctctgattgtaatgtacttgggctcataatcatgctccgcatcaaatcccaactggctctttggaaggtccctgacatggcctcccgatgcatccacctcatagttggcgcccagaaacttcttgatggtcttcacttttgctggtgactccacaattaccagataattcgccattgtaaaactccttactccctgttctttattttcacaaaatggagatgcctccggcatttgcctgagaatatccatactcctgacacttatgtgattgttttcatgtagtgctgacccgatgtcctcactgcgaatccttccaattccagctccagaagagcactcatacagtgtcctgccggaagtcctgtccgtaccataatctgttccagatgtctgggttcggaatccaggcaactatacaccattttttcaatcttggcaagtcccttctcgtctttttcacggttaatcccctttttttcgtgaaaaatgcccatatagtccagtacatcttcaggacaggtcaaaatccctgcccctgactgtataagctcattgcaccccgcgctcaaggcgtccgttatccggcccggcagtgcgaatatctcttttccctgctccagtcccaggctggctgttatgagagaaccgctttttttccgggcctccatcaccagaattacgtctgaaagaccgcttatgatacggtttcgcatgggaaaattcctggccaggggctcctcatccggtccaaactcggagagaatacctccctgggacggaatggcatcatacagatggtaattgcttctgggatagcagatgtttaccccgcatccaagaactgcgtatgtccttccatttcctttcatagccccctcatgccctgctccgtcaatacccagagccaggccgctgataatctgtacaccggctttcgccagctccctgcccatgtatccggctgcctgtctgccgtagtccgtacagttcctggctccaatgatggctgcagtggggcgtttttcatccggcagtccaccctttacataaagtcccatgggatagtcataaatatgcagaagccggttcggatattccctgtcaaggggcgttataaaacggattcccttttcctgcaattgctcatattcctgggtcatgcaggaaaaccgttccttccaccggtcataggtgcggcatttttccccgctttgtaagattcccagtttccttaattccattccttctatataatatgcccgctcaaagcttcccgccagctcccatatgcgccgcaatgtcactgccccaaagcctggaatacgggtgaaccagtacaggtactgtttttcacgtctttgcgctaaatccggttccgggccggatgctgcattttgtcttaattcctgctcccttccgctctctatccccatatctgttcctccagtcccccataccccaatgcctccgccagatgttccttccttatatccctgctgtcctccaggtccgcaatggtccgcgctaccttcagtgccttatggtatcttctcgcactgatgcctcctgattcataaatccgctgtgcaaaggccctttcctccggttccagcctgcagtgctgttctacctctttcatccccatgcggctgttaaaacgtatctttgtaccggaaaacctgtgttcctgccgttttctggcatcttccacccgttcccggatggatgccgaatcctcattttctccctggaccgaattcaattccccaaaggtcaccggggacgcctgggcacagatatcgaaccgttccaaaataggcctggatatatgccccaggtatcgtttgatttggctctccgaacagctgcagcggttcctgtccggataaaaaccgcaggggcatagattcatggcagccaccatcatgaagtccgccgggaattcataattgccggacaccctggttaccgtaattttccgttcctccaaaggctgtctcagcatctccaccgcagagcgtccaaaatggggcagttcatccagaaacagcacgccccctgaagccagtgacagttctcctggtctgggcggaatccctccccctgccagcgccctggctgttacggtgtggtgaggacttctgaacggccgttcagacaacaggggacgtcctgccggcagaaggccgcatatgctgtagattctggatatctctatatcctcctcccttgtcagggcaggcaagatggtagggattcttctggctatcattgtcttgccggttccggcgctgccggtgagaagcagtccgtgcataccggctgccgccacctccgccgcccttctcagcagagcctgcccgttgacctccctgtaatccggggcagcctccctgtgacggctgtccgcaggccggtaaggagctgaccggcagggtttagcggaaaacgcgcccttaagaatgcctgccatatggctcagggactcaacccccaccatatcaactccctccatcacaagaccctcttctacgttacccaagggcaggaaacaccttctgatgccctcctccctggccatggctgccagggaaagcactccgcttacaggctttaccctgccgtccagtcccagttctccaatcaccatactgtccttcagcacatcggccctcaccatttggaatgcccccaatatggccacagcaattggaaggtcataggcagtaccgcctttacgtatgcccgccggagacaggttaacggttatctttttagccggaagccgaaaccccgaattcttaagggcggtcctgaccctttcctgggactcccttacctccgaagccagctgtcctgatatggaaaacccaggaaggccgtcagacacatctgcctccacagaaaccaggacgccttccacagcccgtattcctccgctgttaatttgtgtaaacatccatccgcccctttcaacttgtactcttcatgtaatatactttcataaatcaaacggaactttggcacgataccgtaccggattaaaacataagacaggataggaagaaccctatcctcctgaatgaaagatataatcactatactaaaagaagctcggaattacaagggcaatatggactatttttcgtaaagccaattcatgaaacccggctatgggtcccggctatgaaccatgctattttttaaactccgtcatataaggccggaaacgcaggggcagatgggctctctgacatgccggattatgccgttccctgatggcaatggtatcgcagaacatgcgccacatgtccccataggtttcctcgtctgtccgctctttaagccagcagctccacccctggtcgctgtgctcctgttccggttcaaggggctggtttgccagaaaccaggaacagcctgcgggatggactgccgcccttttatggttctcatcgtaaatgacccagttttcctccggaagcctgtctgcaaaatgaggcgccagaagggtcataacatcgtttttcggtccaatgcgtgacaccagtatgcccccctgtgtctctgaaaagcgcagaaattccgtgaggagatgattttcattgtaaacattccggcacagctcaaatatgtcataacaggccggcagctgaagcatgtccagcacagagggaccataccggaaagcctctatcagaaacctgtatatcttatccgcccggtctttgtcctggctcagggaggcagtatacaccttcctgtatatctcctgggaaagctttctgcacacggaacggataaccttctctgccttctccgggcagaccggcacatccctgtactctgcaaaaagctccaattcctcatactcaccctttacggccagccggacatttccatgaccagccgggtccgcccaggcatcgtatacgccgcatagaatcccttcaagccagtcctcgcacatataaaccgtcatatcgtcacctcctgtatccttacaagcttcctgtcaccgcagcatactggtcatcgcctgtcacaggcatctccagatgcatgtcgtcaaacagggataactggcggaagctgtccctgttctcaatgtcccaggctttgcgcctctcatctcccacaagacaggccgtgatatagtcctggtccagtctggcgccttccatcatgcgtcctttgcaggtgatgaaatacctggcccgtttcaggaccacccccatcttctttaaatcctcaaactgcagcccgccctgcttcctggcgtttataatcctctgggccgacttcacccccatgcctggaaccctgagaagctcaccataggaggccctgttgatttccaccggaaactgctccaggtggcgcagggcccagtcgcacttggggtccagaaatacattgaaattgggctgttcctcagataatagctcttctgccttaaatccatagaaccgcagcagccagtccgcctggtaaagcctgtgttcccttaacaggggaggtcttgcagtcacggaaggaagacagctgtcgtcgttgaccggcacataggcggaatagaatacccgtttaaggccgtaattctcatacagggcctgggtgacagccatcatctggtaatcgttctcctgggtggctcccacaatcatctgggtactctggcccgcaggtacaaagggcgtcctggcatactgccagtcgggaaggttccggcctccgcccccatccccctgcctgtccttctctccattacccggaaaataatctcccccgccggacatcccgtggctgccagacagcaattcgcccggctctgccagctccggccgaatcagggcagcgcctcctgcaaaaccagcccgttccgtggcatagggtttcttaaattccctgtcatatcccaggagatggccggacaccgtaatgccctgctgcacctggcgcatgggctttaatatcttatccctggtcttccctggagccaggttcttaagtccctctgccgtgggaagctccaggttgatgctcatacggtcagccaggaagcccatgcgctccaccagctcagggtcagccccaggtatggtcttcacatggatgtatccgttgaaatgccactggttcctgagcttgtaaagtgtctcataaatctgttccatggtatgattggcagtatacaggatgcctgaactcagaaacaggccctcaatgtaattcctgcggtaaaattcaatggtaagcttgcacacttcatccggtgtgaaggcagtccgcaccacgtcattggaacagcggttcacacaatatttgcaatcatagatacactgattggtaaacagaatcttaagaagggaaatacatctgccgtccgccgaaaaactgtggcagattccggactccgaggtgtttcctatgctgcccgcctttcccttcctccttactccgctggatgtacaggccacatcatacttggctgcatccgtaagtatctttaacttttcctgtacgcttagattttcctgtatcagcatgttatcaccatccagaacatatgtttgttctgacagtataacacaatgccgggataaatgcaaccaaaaaacgaacatttgttcttttcggctgcatccttttatccttcccggaattacatacccggatattctcagccccgtgcagcggacacaaaaccataataaaaaggcccggagccgttcacgccgaatctttcgacatgaaaccggccacaggccttctatatattcataaaatcaatgcatgcatcaatggaacctgattctgtccccgtcctgtccttaatccctatacccatccggattcatggactgccacttccaggaatcagcacacatatcctcgatgcctttctctgccacccagcccagctcgcgctttgccttggctgaatcggaataacaggtggccacatccccttcccggcggggctgaatctcatattttaaagtcctgccgcaggctttctcatatgcatggagcacatccagcacactgtagccaacgccggttcccaggttatagatgctgacgccctctttatccttaagcttaagcactgcctttacatggccctttgccaggtccaccacatggatgtaatccctgaccccggtgccgtccggcgtgtcataatcatcgccaaatacattcagatgatccagctttcccactgccacctgggcaatatagggaaccagattgttggggattcccttggggtcctctccaatcagtccgctctcatgcgcgccgatgggattgaaatagcgcagaagcactacgttccactccgggtccgccgtatgtaaatcggtcagtatctgctccagcattcccttggtccgtccgtagggattggtaatctctcccttggggcagttctcggtaatgggtatctcagccgggtccccatacacggtggccgatgaactgaatacaatgttcttgactccatggctgcgcatctcatcgcagagaatcagggtgccggtgatattgttgtggtaatactccaggggcttgcgcacagattcacctactgccttaaggcctgcaaaatggatgaccgaatcaatctcttccctgtcaaacacttccttaagggcaggctggtccagaaggtccgcctcatagaattttaccttcctgcctgttatcttctccactcgttccagtgccttctcgctggagttataaaggttatctactaccaccacatcataacccgctgtcagcagttccacacaggtatggcttccgatatagccggcgccaccagtcactaaaatagccatggtatctcctccttacgaacaattgattgctgcaaaaaggcggaacaggttaagctgctccgcctgctatgactagtataaagggaaagctgtcataaaacaatgcacaattcttctatctttttacaatattttttgaatggcaccctttaaccgtgttttgcaaactctgtccgtatcttctctatggcctttttctcaatccggctcacataggaacgggagatgcccagtttaccggcaatctcccgctgggtatgttccttaccacggtacaatccgtagcgcatccccagaactgtcttctccgtctctgtcagacaggactcaaaggcctcatacagctcctttacatcctgttttaaaatcatggtatccagcgtctctttattgtccatctctatcacatccaccagactgacggtttccccgtccttgtctactccgatgggctcaaaaagggacacttccttggaatacttcctgcttgcacgcagaagcatcagtatctcattttccacgcatctggctgcataggtggccagtcgtgagcctttatctacgttaaatgtattcactgccttaataaggcctatggttcccacggacagcaggtcctccatgtcgtaatcagagccctgatacttttttaccacatgggccaccagacgcatattatgctcaatcagcatatccctggcagactggtcgccctctttgcagcgttccagatactctttttcctctcctgctgataatggtttcggaaaagtcttcaaagaaagccaccctgcatattcttaatcttattctatgcgggggcagcttgccaagtgcttttacaagtttttattggctggtactattttcaggagcaatgacgaacaactcctttaacttcttccggtccaggctgtggttgtacacaagggcctcataatccagtatcatgtcctgatagggacagcgctccgactctgccttggcccagtaataatagattccctccctgtcatagcagcccaggaaatgaaccacgggaaggtcctccttcatggcaaggaggaaccggttgtatggcgtcagctccagattggccctgagcaggacctcagaggacaggtagaccgccccaaggcgccccatgtcctcagaaggcatgctgtaattggtccatatgatgaaaggagtctcataccacatgagatggtcctgtaccggaacctcggaactggacataccggctatgtcatcgtaaaattcatcctcaatgctgggctggtggtccccgaacatgacaatcatagtgggctcatccagcccgctgaaatactccaccaggtactggaaagcctggtctgaccgcttcataagggacaggtattggtctgtcttgggatatttaccctggtaccctccggtaagccatacctcctgctcaaagttttcataggttccctcatatccgccgtggttctgcatggtcacattgaatataaacagcttgtcctcaggatgttcctttgcctccaccatctggaccagcttctcgtaatccgcctggtcgcttacataattgcgcagttccccgctgccttcatagaagtcctggtccaggaactggtcaaatcccatattctgatagcattccacccggttccagttctccccgggataagggtgcatggcaacgctgtaatacccctggtccttcagggtgctgaccagggaataggttcccggctttacattgaactggtaggcaatggagttggcaggcagcagggccatggagtcccctgtgaggaactcaaactcggaattgcttgtcatggacccaaacacaggcatacacaggcttcccctgaccgtattttcctcaaggctgtccataaaagggaaatattctgtattggtggtaaaatcgcctgctgttttcagctctgacagactctcgttcatgatgcatatcagattgaccggcgtcaccggctgttcgtcctccggctggttttccgtatatgtccgggcatttctccggcccgcatatgcggtttcctcctccaggcggctgtatatctccttaagcctggcgctgctgtatccctggggcggcttctttaccacatactggagtgaaaccgctgtggacagcacataaccgtattcctggtatgtcccattgatggcccacatgttgatgccaaggccccaggaaggaaccaggaaggcaaagaaccaggccccataacctgctatggctgcggccatgcctcctcccacagccaggcggagcttccagcccctgacccggcgcggcgcaaaccacagaaacacgttcatggccaggagcaggacaaaggcagtcttcatctggtgagtgataaaaaactcatagttgcccgatacggtcatggctgtcctgaatgccatcacatcccagagcatgatggggcgtcccctgaaggccaccacaaaggtctctgccagggaaatgacatagagagcacaggaggctgcaggcacagcgattctggtcctccctgtgacggcaaataaagccaggtacagcacgtaattccaacctatattcagagccgccatataagaaggaaccgtggtcaggttccccgtgacgtactcaaacatgaagtatgacgccgctggggccattaacagacacacggttcccgctatataccatatattttttataatcttaatcttattttcctttgtcactattgtcgcctttttgtcagaattttgttcataaatcttaataaacttatcctaacataaaggatttgatgattcaagagtcaaatgcttccaagaaagacatttcacaaaaccttcacattttccgtcttaatattcatccgatacgtatacggaattttcccgttacaatccttctgtaaaatatcacggtcagcaaagtcgccgcaatccatccaaagggccaggccatccagatacccgtgcttgcgaaatgttccgtaaggatatttgccacgataatgcggagaatcaaatccggcacagtggccagcacaaaataggtcatggctccggaaccccgtataatgccgtctgtcatgagtttaatggaaatcataaaatacatgggacttacaatgcgcaggaactccatgccggactgtatggccttggtgctttccgcccccaggaacagtcccatcatctggcggctgaacacaaaatacagcaggaaaaacggaaccgtggcatacaaggacagtttgacgcctgtcttaaagcccatgggaatcctctccctctttcccgctcccagattctgggccgtatagctggacaggcagcctcccagggacataaatgcattaatggcaaaggtattgagcttgatggcgccggaatagcctgctatgacagcggagccgtaccggttcacgatttcctggacaaacatgtttcccacagacagcacactctgctgcatgatgctgggcactgcgatggctgctatctgccccagcagaacagcgctgaagagcactgtccttcggccggtcttaagagcgcccagacgcctggacagggtacccagagccaggatggcggaaacgccctgggcaataaaagtagcccatgccactccggccactcccaggcccagccgggccacgaaccagtaatccagcgctatatttcccagggatgagccgataaggaaataaaggggcgtcctcgaatcccccagggctgtgaaaatgcctgtacatacattgtagaggaacaggaatgtcagcccgtatacgtaaatcttaagatacagctccccgtcctggaatatgttgtccggggtatggattacccgcatcatatccccgcagaaggcatatcccagcacagtcagaaccaggctcatggcgccgcaggcaataaatgctgtgtagacggctgtcttcatcctgcctatgtcctttgccccaaagagcctggacaccaccacggaagcacccagattgcttcccaccgcaaatgccatgaatatcaccgtgatgggataggatgcccccacggccgccagtgcatcctcacctgcaaaccggcccgcaatgctgctgtccgcgatattgtaaaactgctggaacatgacgcttatgaacatgggcagcgcaaaccgccacagcgtctttttcggatgctccgccgtcaaatctgtaatcatgataccctctttcctcccaatgacaatttatgttccattatacccttggtccgccattagggcaaccggaaatatagagggactgcaaagaaaaatacggcagaaaattggtaaaagaaaagcgcccggggctttcccttttaggggatttgccgcaggcgcagtatttttacctgataaaaccattagtggtggaacagacggattcccgtaaatgccatcaccattccgtactggttgcaggtctcgatgacctggtcgtcacggacagaacctccgggctgcgccacgtatttcacgccgctcttgctggccctgtcaatgttgtcaccaaaggggaaaaaggcgtcggaacccagggccacgtctgtcatggtgtccagccaggccctcttttcttcagcggtgaatacaggaggctttaccttgaaaatcttttcccatcttccgtcagccagtacatccatgtaatcatcccccatatacacatcaatggcattgtccctgtcagctctcttgatgctgtccgcaaacggaaggttcattacctggggagcctggcgcagataccagttgtccgccttgctgcctgccaggcgcgtacagtgtaccctggactgctgccccgcgccgatgccgatggcctgtccgccctttacatagcatacggagttggactgtgtgtatttcagggtgatgagggaaatcatcaggtcaatcttggcagaatccggaaggtccctgttctcagtgactatatcctccaaaaggtccctgttgatttccaggttgttgtgtccctgctcaaaggtaataccgaatatctgcttgcgctccagggcctccggctcataatccgggtcaatccggatgacattgtaattaccgtttttcttggacttgaggatttccagggcttccggttcatatcccggagcaataacgccgtcagacacctcgcgcttaatgattcttgccgtgtcagcgtcgcacacatcggacagggagataaagtccccgaaggaggacatgcggtccgctccccttgcccttgcataggcgctggccagaggtgagagttcacccatgtcatccacccagtaaatcttcctcagcgtcccgtcaagaggcaggcccactgctgcccctgcaggagatacatgcttgaaagaagccgctgccggaagtcctgtggctgccttcagctctttcaccagctgccagccgtttaacgcgtccatgaaattgatatagccaggtctgccgctcagtactgtgatgggcagttccctgtcaccttccatgaagattctggaaggcttctgatttgggttacagccgtatttaagtgccagttctttcataatgatacctctctccttatttgtttttatttacgattcttgtctcgtacgtaccgtcggaaatattgataaagcgcacgaacagtgacaccttattatcctggttcaggctgttccagaccaaatccgtaaaggcgccgatatccccgcttatacccaccttcttaggttctccctcaaagctggggaggggattgccgtcatgcatataggtgtggataaaacgtccctctcccgctgccggcgactcgtaggcataggtaaaacgcaggcaggaatccggatttccgttatcgctctttaaaatggacatggcatagttataattgctgttttcaatgtgcatgataccggagattcgcggtgtatagttaggcgcatcaggctcgaattccctgcatcttaaggactgctcaaaggtcatctggcggtccattccgccgtagatggtgtcggtctggtctccgttggtcacaatggtcttgtttccaaggacccgtacaggggcatatataatcaggcttggatcctccagcttggcgggatcgaatgcctgggtgcggattccttccccgtcctccacaaatacgcggttgcggctgttggcgcttctgcccatgataaaataagcggttactgcctttgttccatcatcagagcgcccgatgacgattccccgtccgggatacgcattgcctttcagttcctgttccagtgacatctgattcatactgattcctccattcggcttaataggctgctgaaactcaaaagagccggctcccggacacgcaaaaaaatatgcatgcccaggcggtcggctcaaactagttcatggtactgcgtgctccctgtggttgctccactatccgccagtcacacgccctaccattaatatatatctttttttctaatattgcaacccttttttagaagttttactaatcaagagtgttgaggaaagcagtctccggtgccggcatatttcccctattcattccggatggctgccaggggactcagcttcatagcgcgcatggccggcatgaatccggctgccatgcccacaaatatggcaaagaccacggctgcaacggaaagccagggcggtattctggacagattgcctgtcaggccgttcatttcctccaggttgacaaaccggttaatgaccaccgaaataccgtaactgagcaggattcccacaacgcctcccatgaaacctataaagccggattcaatgaggaacatgttccggatatttcccatatcgcagcccagcaccttcataactccgatttccttggtccgctcatagatggacatcatcatggtgttggcaataccgatagccgccacaaacagggatacggctccgattccgccgagaacagcctgtatcatgctggactgctgtttcgtgctctccatccagtctgcctggctgctgacctggaatcccatgtccgctatctgcttctggacctcctggacatattccatatcctccacaaatatctgggcccggttgtaggtcagatagttcaggggctttccctttttgttggtgggctggcccggtataacggttccctttttaaacaccttgcgcagctgggccttcaggccgtcgatatccgtgtacacgttataggaataggaattccagtcatccggaccgccctccaccattccggttgcattcatcatatactttttcggcggtttcaccggagtctggccgtcctccgaggaactaacggaaccatttctggtctggaaataggcatccacgtcaaaaattacgaaaaggggcttattcataaagtccacatccggcatctcgcctgtgtcccagtatccgcggcctgtcttggaattgtaaaaattctgctggaccgtgttgcccaccaccatgcccatctcccccggttcaggaagcctgccctcccccaggggtatctgttccagaaaggactggcttacgcccataagggacagatactgggcctcataggctccctggcgcataaccacattgatttccaggaccggtgatacgccggacacatggggcagacggctaaattgttctatgacatcgtccgtgatgtaggtggggtccgaggatttactgctcccgccccctccaatcatcactgcattgccataggaggaaccggagtacacattgatggtggtcaggcttccccaggaggaaatctgttccatgaacatctggtccagtccgattcccagggataccatgaccacgatggatgccgtaccgataataacgcccagcacggtcagtactgtcctcagcttcctgcgtcttaggttgttaatgctcatgattacgaggtcatgaaatctcatcgtccccatcctcttcccttgctgccttgcgtttcttcctgattcggaggacaactgcagctgcaataccggctgccgccaccgcaccggcaattatcaggaacttatatctgccccagaaggaaggggccgcctccgcgtccatgctgcctgcatccatagccattcccatgtcatcccagtcctgttccatctcctccataaccatgagggtcagctccttttccaccggttcagcgggcacgccgttttcatcctcatattcaatgcggatgcggacggttccctcatcctgggtgggagccactcctgtcagcatggtatccacgttgcctgtttcacctggcttgatgtttcccacataggcgtccgtggtcttgatggaatccgcctcaaaggttacggtcacattgtaaaggatgacctttcccgtgttgttgattccgaacatgacattggactcagacccaacggtcatgctgtcgggcataacgtcaatagtgctggtgctcagacgggcatactgtttcacaggtatgtccaccacaatgctttcctctgcgttcttgaactcagggctgtcatacttctccttcaccgtgatggcgtaggagcgctggtccactcctgccctggccgtgaatctggccctgacctcggtggtctggccgggagccatattgtccaccaccagggaggatgttcctgactccgtggtaaacacagcgctgtccgataccttttccgactccaggttaaagaggatattgctggcaggaaccgaggtggatgcatttttcatgttgagaatcagttcaaactcgtcccctgcatagatttcctccggaaccgtgtgatagctctccacaatcagcctggccctggtcctgtcattggcgttaaaatctcccaggtcgtcctctttatccttggacacaatatgtacataaaaagttccctcctccgtgtgcaggtctccctctgagctcaggcggaaggtaatggtgtatttgattggataatagcctgtgtaggaatccttgcggatagccatgctgtaaggagcggacacagtctctccgggctgcacccgttcaaaagtgcggtcatagttgccgtcattgatttcaaaggggaacttggcgtcgtcctctgacagctgcatgctgaccgtcacatcctgggcagtggtctccctcttgttgcggaaattcacgctgtaatccatgacattgggatagacgcccctgggcgtgggctggccctcacccaccacaaaataattgccctccttcttatcctcctcatcatctgcaccggaggtggatgaggtggaaatccatacattgatgtagtccgtgtcggaaccgccgtcccattcaagcagcacagggatgctgtaatatccctgaagggcgtcgcggcgcactctggctgacagggacacactctttacatttcctttcttgatggtccccacgctcttggccacaaaggtggtctccatgatttcaaaggggtaatagtccacagagtaatccccgtttcccctctcctctatctgctggaactcattggtctccaggagactgatgcgcaggttctccatgtcctcgtccgttgccctgatacggaaaggaatggacatggattttcctatggttcctttcggtgattttgtagtaaatacatagtcattttcactggcattggtgttatagcccagtttataatcgctggccgctgcgctggacggagacatcccggccagcatacaggccgccataaacgccgtcaagcctttgcaccacttatttgctctcattctcattgcactcctttttctctgcattcccctcatctgacgcttccctgccgcctgtctcgattcccacaatccggccgtccataatccggattctccggtccgcataggaggccagattgttgtcatgggttaccataaccagcgtctggttctgctccctgacaatcttctgcatcaggcgcagcacctccatggtagtcttggaatccaggtttcctgtgggctcgtcggcaaatataatctgagggttcacaaccagggctctggcaatccccacccgctgctgctgtccgccggacatctggttgggcatatgcttagcctgtccccccactcctaccaggtccatgaattttctggcttccttaagacgcagtctcctggaaacaccccgaaaggaaagggggagggccacattttccagggcattcatggtattgagaaggttgtatgcctggaagatgaatcccaccttttcacggcggaagctgaccagctgccgctccgtcatcttctctatatggaccttaccaatctcaatctctcccttagtcggcttctccagcccggccagcatgttgagaagggtggatttgccggaaccggaggcgcctactatggcaacgaactcacccttatatatgtcaaaatccagtccgtccagggcccggaccttgatatctcctaccttgtatatcttatataaattcttgacccgtatgaccacgggccggttttccagctgttcctctgccaaacccaggctcctttccggggcgtaaacgcgctccaatctggataacagcccctatggacagactgttactaattttgttcagtatagcacagagacggtgttttgttcttctgtttttctttaatcttcctttaataattccttacaccccacctgttttcagtagcaaatgtaacacgaaaacaggtaattgtaaagtaaatcagaccagagtacggcaaaaagaccggactcccgctgcttttcagccggggtccggtcctggatgtttccagtgttttaaaatatgatttaagcgtacctgacataggacaaaagatatccctttttcttcagccatttcatatccagccggaagggaaggcccggaatgtccggcaggtaaaagcgtccctccctgcgctccacggtcacttccatgcagtccaatacaggctggttgcatacctccaggaattcctccatggcctcatcccctgccgtggcaatcagcgggcaggcaagaagtggcaggccgcctgaagaaaaacgtatgttgttttggaccgccatgtcccgcacctgcatccattcccttactcctgcaaaggaggagggaaccggctggaaatggcggactcctgcatccagataaggtgtgaacatatagtggttgcgcaccgactcaccggcggccacgggaatgggacagctttctgccaattcaccgtagcccttaaaatcaaaaccgtgaatgggttcctcaaaccatgcaatatcatatttctgaaccttatccgcaaatacaagtgcctcccgtaccgtaaaggaatggttgccgtcaatggccagctccgcatccggaccaatggtctccctcaccagccggacgcgctccacgtcatactcctgcttcgtggcaaaatccgtgcccaccttcatcttcaccgtcttatgtccgcagcccatgaaatgctccatttccctggcaagaccggcgccgcttaggtgtgtgcttccgccgcttccgtataccgcaacgctgtccttcagagctcccaggaaccggtggaagggcatccctgcgcgctttgccaggatgtcggtgagaaggtactcaagctttcccacctccccggctgtctcgccgtcaaaaccggaattgcggcacgcccagtataccttgtgcatccattggccgaagctcttttcctccccggtcatgatgaggggaagtatggtcttttccatgatggatgagcagggacacacgcccctcaccccgtccttcgtataaagctccacatatttacttatcttggaatgggtaaagggccctccggttgcatcgtaaaatggctccttctggggtaccggcgcaaggttgatgataaatgcatctgtgaaggcaagcagttggctgtcatactccatgtccatctattcccatccttttggaagatatgcaagcgtgttcttcagcatgtcgtccaccagaagcctgacatcctcttccctgcagttctttccctttacaagcgggtcgttcataaatgccctgaccaccttctccttatccggcttaagggctgcttccataatcagctcatggttttccagatggggcatcagaagttcctttacttgttcaggcacagctcctgcaaccaccgggtaaatgtggtccttttcaaagacagcattggtctccaccagggcgtctgacggcaggttggtaatctggcaggccgtattggggatatttacattgctgacaacccttgtaaggccgcagagggccttgattaaaagaatcccctcttcaccggtgggctccagcttcacttcctcactgccggaagccagtctgctgcttctctccagcctttccttcaggtcattcttcctccactgcaccgtggtcagcccgaatttccaggatgcaactgtctccgggtcattcaggtactcatttccaggcatgaactcagccagatgccggtcgcctgcagcagcaatgaggccgtacctcttaaacaggtccattttaacccggttggcgcatttaaaggaggaattcatccagttttccccttccacctcatacccctggtcaaaatgcctgtcaatataatccctgtacacagggaataaatcaattcccttataggatgcgcttgaaaaccaggtgaaatggttgatacccagcacattcacatggatgtcatgccagtcaatatctgtctctccgcagctttcctcgcagattcctttaaggaccttctgtgtgccaaatacctcatggcagcacccgaatgccttaatttccggaaatacatgatacaatgtctttacgcacagcgacatcgggttggtataattgattacccatgcctttggcgcgtactcctttatggcctcggcaatgtccacgaacatgggaatggtgcgcagggcccggaccattccgcctggtcccgccgtatcgcctaccgactggtagattcccaggcgctccggaagatggacgtcggactccatctcatcaaaggtacccggaagaatggagatgacaacgaaatcacagccggtcagggcgtccttaaggcttaagctggtctcaaatttccagtctcccttggcgtcatccctctgcatcaggcggttgccgataatctcattgttctttgccgcctcactgtcaatatcatacagccttatggtgccgctgatttggtcctccagggccaggtctgtcataaaggtccaggcccatcccctggaaccgcctccaatgtatgcaatctgaatatccgtcaccttattatcactatacttcatattatcctccttgttatgagcactttattcttactgaaaatacaccttctcagcatttctgtacatgatttgttctttttcctccctggaaaatgcatcactgcaggtaatatactgaatcagatgctgatagctgtcctccttcagcaccgaaggtatatctgttccaaagatgagacggtctgcccctgctatctcgattccatgcctcagataccgcaccgcgttgggataggggtaggcgtcagggccgcagttatggggcagggccgccaaatcaaaccacacattgggcagggccagcttcctgagcccttccaccagcttatcctcatccctcatggacacggccagcagatggcagaccacaaacttcatgcccggatgctccattatcacagttctgagccggtcagtctgccagctctcgctgccgcatttgccgatgtcaatgacaaacaccagaccatgctcgtccgcataatcatattcagccttcatgatatccccgtccaggggcagcgtaaagtgactggccatgagcccggaacccgtgctgacctcaaactttacaatggaaaaacccagttcttcaaacaggtgtctgcgtatctgttccctgttccggcaaaaggggtcgtaggaggcggctgcccggaaccggtccggatattttttaaccgcatccatggaataaagattctggaaaccaaagtaatttccctgcagcagcactgccttctccactccgttctcatccatcttccgcagaatatccccggccgtcaccactccgccggagaattcatccggaagcatcctgaaccgttctcccgaagcatattccgccatgccgtctccggcataacgcagctccccgcctgcccctgttccggctatgtactgtaccagatggacgtgtccgtctattatcttcatttcatgttccatatgtattatcctttcaggccggaagtactgatgccctcaaccagatatttctggaaaaacaggaatataaggatggacggcaggatggatagggtagccatggcgaacatggcgccgtaatccgatgatgagcccgggtcgcagaaaagcttaagcgcaaggctgaccgggtacatgctggatttgctgacatacagcagggccgacaggaaatcatcccatctccacatgaaggagaatatacaggccgtaaccaatgccggcttaataagaggcagcataatgcgtgtaaaaatacctgcataggaacatccgtcaatcttggccgcctcatccagctccgtgggaatgccgctgatgaagttggaaatcaggtacacgaagaatccctgtatggcaaagaaatacggaacagtcaaaggcatgtaggaacccacccagcccagcttctgataccacagatactggggaatcatcagcacctgggcgggaagcatcatggacagcagcatggctgcaaacagaatgcccctgcccctgaacttgaacctggcaaacccgtaggccaccagggcggatgaggctacggttcccagggtggctaccactgagataaagatggaattcttaaagaacgtggcaaaggaaatctttccaaaccctttccatcccgtggaataattgctgactatgaatttctccggtatcaggctgcctgctgtggagaatatggtgctgttctccttaaaggaactcatgaccatccatatgaggggataaatcatgataattccgatgacgaaaacaatcacatggtatactgcttttttcaccactcgcttctctttcatgattaaagacctccttcatatacccagaaccgttttgtggcaaacaggaacagggttatcaggccaatcacagccagcatgacccatgccagggctgcaccgtatcctgtgttgtagaattcaaaggactgcttatacatatacacggtatagagcagggtggaattcatgggttttccctgggtaatgatatagcactgggtaaaagccaggaatccgttaatcatctgcatgaccaggttgaaaaatatggtaggtgtcagcaggggcagggtaatcttaaagaactttgccggagcgctggcgccgtccacctcagcagcctcatacagggactggggaacctgctttaaggatgagaggaagataagcatggatgaaccaaactgccagaccaccagtaatataagaacccatatggctgtcctggtatcgcccagccatgaaaagctggtctggattcccatcattcccagaagcttgtttaccacgccgtccatggcaaacatcctcttccataagatggatactgccacggaaccgccgatgatggaaggaaggtaataggcggccctgtaaaaaccggacattttggaattttccagcaaaagcatggccacaatcaaagcaaacagaagtttgagcggtacagacacaaatgcaaagaaaaacgtcaccttcagtgttttaaaaaacgtctcgtcctggaacatggaaataaaattcttaaggcctgtaaaaacaggcggcgacaggatatcgtagtcgcagaacgaataatacaatgaaattcccattggaacaatcatgaacagcaggaatccaatggtaaagggcagtgtaaacaggacaccggccacactttccttgctgagctgctgctttaattccttcatagcctctcctcctggtaaaagagcggccgccagcagccgctctttttaatttgttaatttttcttggactccatgatttttgaaccctctgtaaacagctgctgtccggcatcctcagccgtcatctggccgtagcacacctgctcctccagcttgttgagaaggtcgtttacctcgctggagccgtcggctgccggcgggttaatctgggaagaattatcggatacaacttcattgataaacttaattacttcctggctggtctcatccatcttaggcgcaatggaatcagctacggatgaagacagaggaatacctctctcgcctaaaaggatttcattacactcaactgaattggtgataaagttcaggaccttggctgcctcgtccggatttgcactgtcctttgtaactgcgaagaactggcttggcttcagataatcggacttaacagggtctgctgacggccaggtggtcatggcaatctccacgccttcaggcgcagcgcttcggatggctgtaagctggttggtatagttgaatgcgcaccaggacattgtctcaggattggaaccatataccattgggtcctgctccacggagccgatggttctctctgcaaatatggaaggatccacaacccatccgtccctaatgccttcctcgtagagcttgaaataggacacataatcctctgctgttccgcccagctttccttcctcgaacatgactacatcattggcacggaggaaatattcgatgaagttctcgccgttgttatatgcgatgttggtcttataccctgtcttttccctgatttccttgcagagggcaatgaactcgtccatggtcatgttgtcttttaccgtgatgcctgcctcatccagggctgtcttgttgtacagcagggccggcgcgttgatgccgttgcagatagcgtaaagcccctctcccaccttaccggagttcagtacatcctcattgcagtttgacacgtcgatggtgccgtcttcaatataaggtgtcaagtccaccagcaaatcattgttcacatactgctggatgtatttgtaatccatctggacaatgtcaggcatggaatgtccggcagcagcggttgccagcttgttccagtaatctgcccactctgagaactgcccgtcaaatgtaacgcctggattctgttccgagtacagctccagaatggcctgagtgcgctcatttcttacctggttgccccaccaggcaaccaccatttcagaactgtctccggctgcggctgtttccccggaagccccctctgcctgtgaaccggctgccttggtatctgttgtaccggaaccgccgcatgctgtcaggcttgctgctgccagggcagctgtgagcaccaatgctaatttctttttcatgattaaaacctccctcgttcttcaattgcttttgatgaactgattatacctgcttttttcttccaaaccaatcaataaaaccgatgtccatgattaattttccgacttttttacaccatttatacagatgaaactttcccttgtcctgttggaggatatggtatatattaaattaagacaggaaatttccactgaaaacaggagaaacttatgaaatacctgaaacggataaaacatgactttgaaaatctatccatgaaaaacaagctgctggccgttgtattgtccaatgtggtgctgattctgattatagcgctggcaggactgcggatttcctccaatgcatacaatgaacagctctacaaggccattgccggaaatctgtccttttcatcccggaccatttccagcaacttaaagagcatcgagaccctttcctctgtcattatctcctcctctgtgattcaggattccttaaacagcattgacagtacggatgaccctcttgtatggtctgacaacaacccgctcatcagcacagccatcaacaattaccagcaggcatataaaaataacggcgtatccgcgattgccttaaacaaccggtatttccagaacctgacgaacttcgtggtcataaacaatgcagatggggacacggtgcaggacgcggtggacagggccaggcagcgtgagggagccatcacctggaccatcgactatgaccacggcctgtatatactcagccgcagtgtcaggaaggtgtacaacctggagctggaccacctgggcgatctgctggtatttgtggacctggaccggattgtaagggatgccaaccgggcggtgaccacctatgatgattccagctatatcctctttgacggggaccagctcatttacacctctgccggaatcgaccctgaaaccgccaatggctttatgaaacagacgggccagccctacagcattgtgcaccatgacgggcacagctattttgcagttaagaacaccattccccattacaactggacttacataaacctggtcccatatgaccagattgccaattccacaggcatggcctaccggcttatcctggccatgctcattgtgggcttcatcattgccatggcattttccagacggctgacccgttacatcttaaaggacttcaatcttttaatcaaaaagatggaattcttcagcagcacggagcttaaaatgcctgaggtggaggtggattacagtaaacggaccgatgaaatcagccggctgcaccagcattttgacaccatggcggggcgcatccagtacctggtccagaacaattatgtgaatcagattttaagccgggacgccaagcttaaggcgctggaatcccaaatcaatccccactttttatacaacaccctggaaaccattaactggagggccaaggcgctgaaggaccagcagatttcctccatggtggaatccctgggaaccctgctccgcgccaccctcagcaacaaaaaacccctggtgaccctggactatgagattgggctggccggaagctacatgaccatccagaaaatacgctttgaggaccgccttctcttccatgtggagtgtcccgaagaactgggcagggcccttatcctgccccttaccatccagccccttctggaaaatgccatccgctacggcatggaagaaatgatggatacctgcgaaatcagcatacggacctatcgggaaggggagctgctgattgtggaggtgtcaaatgaaggctctgtatttgaggacggactccttgaaaagcttcaggacggcaccaaaaatgcccatggctttggcatcggcctggtcaatatccaccagcgcatccagatgttttttggggaatcctacgggctgtcctttaagaacctgaatgaaaaggccattgcagtcatcacaataccatacagaacagaggaagaagactatgcttaaattaatcattgcagacgatgaacgcatcatacgagaaaccatatccaccatcatcaactggaaggagtacgacatcgaggtggtgggcctgtgcaaaaacggcatggaaacatatgacatgataatggacgaaacgccggatatcgtgctgaccgacatccggatgcccggcatggacggcctggagctgattcgcaggatttcaggcacggatttaaatgtacagttcatcatcctctccggctacggggagtttgagtacgccaaggaagccatgaaaaacggggtcaagtactatctccttaagccctgcaatgaactgcagattattgactgtattgagcagtgcaaaaaggactgttaccagcagaaaatcatggagcggatagtgtcagaccgcttcatggcaatcaacagcatgaaccacaatgtcattttcagtattatcaatgacagcatatgccagaaccgcagttttcccgacatcatacggtcctatgaatcctacatcgactttaaattcacaggctacaggctgtattacgtgtatttcctgtcctttgaacacctggaggagtttctggatgatttaaggctgtactgcggggaaaacatctcctcggtcatcatccacggcatatacgtaaataataccctgcttctgttctttaaggactttgccgcaaactaccgggacctggaacgtttcatctgccaaaggcactaccagggccaggccgttaccctggaaaccgaatccaccctgtattccaacctggaacagcttctggtggtggtccttaagaaaatcaggcggtttgggatgatttactatatcaataatttccatctgctctacacctgcaattacaacacccatataaatgaactggagcagctgtgccagtccatcctgaacaggcaccaggattccatgcagaagctgaccgagcttattaaggatataaatgacatcacctttttaaaacagattgccagcaacctgtttatgaagcttaccctgaacatcccttccctctcatccacccagctgaccgaactgctggtccggattgaaaatgaacagagtctgacagaccttaaaaaccttgccattgaacgggtggaggatatactgagggagccggacagcggccagtccgtcagcaccatgacccagcagatatttgattatgtaagccggaacctgcaggatgacaacctgacccttaaatatattgccaaaaactatctctttatgaatgtggactatgtcagcaaaaaattcctgaaggaaacaggcaccaagttttccacctacctggctgacatgcggattaagaccgccaaacagctgctggcatccagaggacttgataagatacaggacgtggcccaggaagtgggactcggaaacaatccacagtatttttcccagctattcaagaaaaaaacaggtatgacccccagcgcctacatcacacaggtctgcggaagaccaggcagataaagggcaatcccctttgccccaggcaatctccgcagacaattttttaaaaagcctgtaatttttacttgacttataccacattctatgtaagaatatgacgaggcacaaatcagtgccatatctggctggtccggctatcgcactggtagagtgtgaactatttcccaaaatcaatattttacaatataatgcgcaaaggagactcccatgagacatttattgaatcccttagacttctctgtggaagaaattgatgaccttctggcccttgcaagggacattgaacagaatcttccaggatatgcccatgtatgtgacggcaagaaactggccacccttttctacgagccaagtacacggacacgtttaagttttgaagctgccatgctgaacctgggcggcagtgtattaggtttttcatccgccaattccagttctgctgcaaaaggcgaaagcgtagccgataccatccgcatgatttcctgttatgctgatatctgtgccatgaggcatccaaaagaaggcgctgcattcgtagccgcccagaaggcccagattccagtcattaatgccggggatggcggccaccaacatcccacccagaccttaactgaccttatgaccatacgctccatgaagggacgtctggacaatctgacggtcggcttctgcggagacctgaaattcggccgtaccgtacattccttaatcaacgccatggtccgttatcccaacatcaaatttatactgatttcccctcctgagctgcgtatcccggacaatatccgcgacgacgtgctcattgccaaccatgtgccttttgaggaggtgggcaacctggacgacgctctggggcagttagacatcctttacatgacacgcgtacagaaggagcgcttcttcaatgaggaagattacatccgtttgaaagactgttacattttagataagaagaaaatgaagcttgccaaggaagacatgtatgtgctccatcctcttcccagggtaaatgaaatatccgtggaagtggatgacgacccaagggctgcctatttcaagcaggcacagtacggcgtatacgtgcgtatggcattaatcatgagattactggaggtgcagaagccatgttaaacatcagcggattaaaagaaggcattgtcctggaccacattgaggcaggaaaaagcctggacatctactatcacctgggcctggacaagctggaatgccaggtagccatcatcaagaatgcccgcagcaacaagatgggacgcaaggatatcattaaaatcgagggcggactggatacggttgacttaaaggtactgggctacattgaccacaacattacggtgaacatcatccgcggggacaagattgccgaaaaacgggcattaaagcttcccaagaaaatcaccaatgtgattcagtgcaagaacccccgctgcatcacatccattgagcaggagcttccccatatcttctacctggcagacgagaaggcagaggtttaccgctgccagtactgcgaagagaaatacagcgaatttaaataaaaaggttgtgggacattcccataaatacatgaaaaggcagcccggcgtcaattccctttggaattcgccggactgccttatcttttttcccagacccattatctctgcttatcagccggcacgatttccagccagtaaccgtccggatccttgatgaaataaatgcccatgcccggattctcgtagcagatgcatcccatctcctcatggtgcttatggcagctctcaaaatcatccacatggaatgccaggtggaattcgcactctcccaggtcataggcttcctgccggtcccgcagccatgtcagctccagggtaaagccagttacgccgtctcccagatataccagcttaaaggagccgtccgaagcatttttctctctcaccggttccaggtccagcgcctccttataaaaggccaggctcttttccaaatccaatacattaaaattaaaatggttaaatgtaatcatagttctctcctttctttgtacaaaaccggcctgcaccgcaggatgcagaccggtacatgaaacatgtttaattcttgggaaccatcacttccatgccgcccatgtaaggacgcagcacttccggaatcttcacgctgccgtccgcctgaaggttgttctccaggaaagcgatcagcatacgcggaggagccaccacagtattgttcagggtgtgggccaggtacttgcctccgtcctccccctgtacgcggattctcagacggcgggcctgggcatctcccaggttggagcagcttcccacctcaaaatacttcttctgtcttggggaccatgcctccacatccacggacttcaccttaaggtcagccaggtcgccggagcagcactccagtgtgcggaccggaacatccagggaacggaataaatccacggtgttctgccacagcttgtcataccacatagggctttcctcaggcctgcagaccacaatcatctcctgcttttcaaactggtggatacggtaaacgcctctctcctcaatgccgtgggcgcccttctccttgcgaaaacagggagaatagctggtcagggtcaggggaagctgctgctccggcgtgatggtgtcgatgaatttgccaatcatggagtgctcgctggtaccaatcaggtacaggtcctccccctcaatcttatacatcatggcatccatctcggcaaagctcataacgcctgttaccacgttgctgcgaatcatgaaaggaggcacgcagtaggtaaatccgcggttaatcataaaatcccttgcataggaaatcactgctgaatgaagccttgcaatatctcccatcagataatagaagccattgcccgccactcttctggccgcgtccaggtcaatgccgttaaaccgctccataatgtctgtgtgatagggaatctcaaaatccggtaccacgggctcgccaaaccgctccacttccacgttttcactgtcatccctgccaatgggtacggttgggtcgatgatattgggaatggtcatcataatctttgtaatcttctcagaaagctgtccttctttttcctccagctccgccagacgtgctgaattggcgctgacctcctgcttcacggcctctgcctcgtccttcctgccctggcccatgagcatgccaatctgcttggacagtttattgcggctggcccttaaatcatcggcctccttctgtgtagtccttgcctctgtgtccagtgaaatcacttcgtccaccagcggcagcttgctgtcctggaatttattcttaatgttctgctttacaatctccgggttctctctaacaaatcttaaatctaacatggtattcctcctggatttccttgatatactatcttccatttctggacaggtattcctgtactgttaaagagtatataacattttcccaggaaataaaagccctttttctgttttttcctgctgccgttttccttctgtctgtctgctgtaccggcatacgccgtccacataagtggcttccaccggaatgcaggccagctcctccggggcggtttcaaaaggatttgcccccagtatcacaaaatccgccagcattcccggagcaatccgtccctttaccctctcctcaaaggaagcccaggcgccttctgcggtataggaatccagggcctgctttatatccagggcctgttccggaagataggggcctgtatggtcactcaccgttgtcctggtaaccgcgcattgtattcccttcatcacatccggcagctccaccggacagtctgagccattggaggtacgggtaatctcatagagggtccggaaatgatagctggatgcagccctctcctttccaatgcgttcctccacaatgtggatgtcataatcaagaaaaatggactggatgtatgcatggagggacagccttccaaactgctccagctggtccggccgtgtaatctggcagtggacaatgccgtggcggtggtcctctctgggattctgtgcaagggccgtttcataggctgccaggacatcatccagaatgccgtccccaatggcatggacagccacctgcattccctgggaattggcatagcccaccatatccttaagctgctgtctggtaaaaatagggattccccgggtggatgcgtcgtccgcgtagggctggctgagataggcgctcctggctcccagggaaccgtctcccagcattttaagggggccaatcttaaaccattggctgccccagcccgtattataccccttttccacaaatcccttaagctcctccagggtggtgaactgggactgctcacagacccggaccgtcatccttccctctgcttccagttccctgtatgcctccagcaccctctcataaggcacgttgttaaaggccagcaaatcatctgtctgggaggaggtgacaccgtaacggttcagcgctttggacgctgtccgtatcatttcctttatatcctcctttgccggctcaggcaggcatccatagattaggtccattgcattttcccggaatattccgttgggcatcccgttttcatccacctcatagaggccgccttccgcctggggcgtattcccagtgacgcctgccagattaagggccatggtattcaccacacaggcgtggccgcatgtccttgtaagacagatggggtggtccgtggatatcatatccaggtcatggcggtccggaaaccgcttttcgtcctgaaaataatcatggttccatccccttcccattacccaggtaccgggctttacggactgttcccggataaattccttcatatactccttcattccggccagggaccgggtgtgcagggataaatccgctgcgcggagggcgtttccatagctcagaatatgcatgtgggaatcattaaatccggcgcacacaaaccttccctttaaatccttcacctcatcccctgcatcccccatggccagggcgccttcatcagtgcctgcataaataaacttaccctcctccaccacaaaggcccggcacaggggaaactcccctgtgtacacaacgccattccgatagattgttctcatgccgtccctccccttattcagtcttatcctgccccgcttacagctgtcacagaccaaactcatgaaataaccggtcctgatactgccggtccgtggccgcccgaataatatcatctgtcctgccagcctctgccagccttgcattcagggtgtttacacgctcaagcgcctgtacggccccttctcttttgccttccctcatacccttctcaatacctttctcaataccttgctcaataccttgctccaacagcatttcacctagaacagtcattccaatcctctcctttatctgacctaattcctcccggttcaagaacttgactgccagtgcatacagcactgactgcatcttttttctctcgtcatcgtctatatcaagttccttcctctgtaaaaactccatcccctgataaatgcgtttcgccatgcccatggttcccgacatgaacggagccaacagcagcggaaacacatcgcggcgtttcagcgccttacccttgcgaatcttccgccccagcttttcaaaaaccttatccccactcctgtctctcagacgcaccagttttattctgtagacactatcaccattcatcagttccctcatcaggacctttacctttgatgtgcacaataccacggtcgtaacctggacatcatacgcaaatcctatgtaggcctcgtattcacggaaccgcctcaagtctttctgcgtaatgctgtcgctctcaaactccagatgcctccatgaaccgtctgtcatgatgaaattaaagtcctcctccagcctgcgcatctccagatgaatgtgttcagtaggcgcaattccggctatcctgccctctactcccacatacggcagtaaatcctcgccaaaaaactgggccgccatcttcatcacccggtcctctatctggctaaagcccatgttttccgcccggtcagactggtttctttttcccatacagcctcctgttccggcaagccatataagaccctatccccattatagcgttttctcataaaccagacaatagttcctttgcctttcgtgtactaaaacgatacttaataatggaataattgcccgacgtatatgtatactgggctgaataattagatgaaagctaaaaaacagatacattcagatttcttaaaataggataatgagcgatagatgcttatatttccctattgtctggtttctataatataacaccatcccgggaaaaacgcaatggataagcttttttattctgccgcctgaactgtggcctgcatacaatccaggcggcctttccgcctcatgtcagcgtccccgccttatgccggttttcccgcgccgcatcaagcttccccgctttataccggttttcccggttcatgcctgctgtccactgcacggacaagcacctccatcagttcctcaaagcacacgccgttggctatgggtatttccagctcctcggacctggcaatgcaggcttttacgaaagaggccgccaggcgcaccgcgcggtccagactccatccccttacggcggcagccgacaccacggaggagaacacatccccggttcccggcctctcatggcccacacgcctggttctagggaaggcggtccgctctccctcagccaccacattcataataaaaccgccctggttcacacctgtgataaccacgcatctgggtcccatggcctggatttcccctgccagctccttaagttccgtcctgctccagccatccctgcggtaagtcctgccggtcaggatacacgcttctgtcagattgggggtaacaatatcccccatggacaccagctccttcatgcggctgcacatggccggcgtataggtcgcataagtctccccgtggtcccccataattgggtctataattaccttggtatcttcctggccgaactgccgtatcacatccatcacaatctcaatctgcgcctcggaacccagaaaaccgctgacaatgccgtcaaaggtcagctccagctccttccacttgcggatgaactctcccatcttcgccgtgtaatcgtcaaagaaatagacgggaaaccctgtgtggttggacaagatggaggtgggtatggggcagcactggaccttcatggcggataaaatgggaatagccactgtcagggaacagcggccgtatccggataaatcattaatcatggcaatctttttctgtcggtaagcactcatgtcaaatctcctgtcatctgagccggtcaaagagcccggtccttataagtgtgctgcgaaggggcatgtagatggccaccgccgcaatggcagatgtaaccgcattgatggaggtggaggcaatgttccaggccagcaccagctctgccgcaggcttgcccagaatggccagcttataataatatcccaccaatgggtcaaaaataacattgaacagcagcccgcagacagaggcagccaccacaaaacggaatacatggcgcttatcggagctctcattaatcctgccaagcctgtgggccaccagaccggttatcaggccgatgcagagttttaacagaaaggttttcggcgcatacacaacataaacagggtcgaacaaatccccgatggtcatgcccagagcaccccctaatccgccgtaaaaacctcctaacatcagggctcccaggacacagaccgcattgcccagatggatggaggtggcatcgcctcccggaagggtaatctttatctgcaaaaatgtaaaaaccacataggataatgccgcaaacaggccggtcagggccagcttgtagatacggctgtcttccaggcccctgttatgacctgctgtcactgcactggatgtcttcatactaacactctcctcatattgtatatttcttactgcatggaatgcatccattcatgtcacctatggtatcactaaggtggaatgttttaaatatccagtttgataagttttgaccaggccagttttgtaagaattcatgaaaacaaacatccggaatcaattttgtcaatcatgggattccaccacaatcagcaccccgtccgtaaaggtaatggtcccttcctcccccacaagttcattgctgatacagaggctggtgcctatttctatgtccttctcatggagcgggtacttaaagccggtaagggtaatgcccctgacctccccggtaagcggaaggaaggaaatgtatttcccccaggtctcattcctcttaaaggtcctctccccgtctatcaggtaaatacggttctggctgtccaggatatatgcctccattcccttttgcaggcatggaaacagcagatggatattgcccagcatatggtccatgcgtccgcctgtggcacccagcaccaccacctgggtgcatcccgttgcctgggcttttaaaagggccagctctgtgtccgtttcatccttttccggctgatgggtatcccagacaatatgttccattctcctgtaatatgccagtacctccggccgcaccgtgtcaaaatcacctacaatcatatccggctccaggcccagggcctttacggcctccagtcctgcatccactgcaatgactttatcaaatgtttcctgtcccaaaaaagaaccggcgaaggacaggtccagttttccgccggttataatcagacaacgcttcatttctcatattcctttaaaatatccatgaattccctggttctggcagaggggtcctggccaaagacagcagagccagccacaaatatattggcgcccgcctcaatgatttcccggacattgcctgcatttacaccgccgtccacctgaatgtccgtcttaagcccctggtcattcagcatgtctctgagccggcgtatcttgttcagggtataaggaataaacttctggcctccgaaaccaggattcacggtcattataagcaccatatccagagcaccgaggatacactccagggattccacgggtgtggccggattcaaagccacgcctgccttcagaccggcttccttaatctggttcaccacacggtccagatgggtacaggcctcagcctggactgttataatatccgctccgcagtccttcatatcctccacatagcgtcccggctcctccaccatcatgtgcacatcaaaaacagcccttgtacatgggcgcaggctcttgattaccggcatgccaaaggagatgctgggcacaaaagccccgtccatcacgtccaggtgaagatactcggcccctgccccgtacacctccttcacctgttctcccaggcgggtaaaatcagccgcaagaatcgacggcgctaatttataatacatgtctagtacctccttttatttttcaggtcctcatacatgaggatgtaattgtcataccggctggcgctcagctcaccccgtttcagggcctccttcacaccgcagacccgctcgcccacgtggaggcatcccaggaatttgcactcgtcctcatatggcccgaactcaggaaaataatccttcaacgctcccggctccagggtatcaatgaacatggagctgaatcccggcgtatccatcatgtaggtgtcctcttccacataaaacagttcggaatgccgggtggtatggcgtcccctctcaatcttatggctgatatcccctgtctccatggctgcctgaggctggatgcagttagtcagtgaggattttcccacgcccgacggcccggccagtactgaggtttttcctctgaggatttttctcatttcccccagccctgtgtcgtcgtaggtactgacaaaatggacctcataccctgccctctcatagatagcccggtacttatccacaagacctgcctcccccaaatcaaccttgttaaagcagatgatgaccggcaccccctgaatccccatcatcaccagaaaacggtccagaaggttcagattcggttccggatgcgtgacggcaaacacgaccagagcctggtccacatttgccacggccggacggataagggcgttctcccggggaaggatggcgtcgatattcccctccttctccccctcatccaaaacagagaactccacattgtcccccaccaggggcttaatcttgcggttgcggaacacgcccttagccttgcactggtacacatggttcctgccgtcattgacataataaaagcctgcaattcctttgattatcttacctgtcatatactcctcttatcccaccgggaaaaatgacaccggataggacttgattactgttaaattatctgcatccaccacttccaccataccgctgtccacaccgtaggcccccttgattctggggaataccacgggcacggtctgggctcccactaccagccttggactcattagggtggtgtaaacagaagcaccctcatcgttggtctggttgaggcgaatcagcacgcgcacgctgctggtctgggaagccggtcctatatagttgctcagggaacatgcctcgtcaatagagccgatataatacctctcatcctccgcctgggtctgtgcaggcttgccgctgaccacataatccactgctgagcccggaggaagaatggttcccggcgactctgactgattgataatcaggccctcctccaccgtatcgctggcctccatggtcacatttcctgttaaaaggcctgcgcctgccagcagggcgtctgctgatgtgggcggctgtcccagaagattggggacccgtccctccacattctgggagcccttgcttacatagaggctgacactctcgcccaccttcaccacctgggggctgaaccgaatcacattgccctttatgacagtgtcgctgttctcctctgcaacctccacagccagccctttctgctccagcagaagcttggcgtcctctccggtcatctgggtcaggtccatggcattcaggtccaccttatcgctgcccttgctgattgtcactcccacggtactccacttcttgaccacggtgcctgccagaatatcctggcccatgacctgtccttccgtatagttatcagagtactcgctgcccatgacctccatcaccaggctgctctccttcagcttttccctggccatatcctggggcagccccagaacactgggcatatttatctggtcctctgtgttaatgtccacaatggtgggggcgccttcggtggtcacggcaactgtctctgtggacggcttattgctgccctgcctgaagagccctgtaaggcgtgaaaatacaaacagcaccaccgccacaataatgattgccgccacaataccgaaggccgtaatgatgcgctcaaactgagtgctcacatcgtctccgtcgttctttttcctggtatggaggcggccttcttttttgtgctgtttcggcttgttcctgccctggggttcagtcttttcttcctccggttcatccagaacctcctcgggatagtttttcctgccgccctggatgctgttcagttcttcccttgtaatggacctggtcttgccaagctcatcctcttccccgtccttgcgggcatagatatccccctccgggtccatcagagccttacgaaggtcctcaatcacatccgccacacaggaataacggcggtcaggacgtttttgcgtacattttaatataatctgttccagcgcatgggacatgtcaggcacatactggctgggcggcgtaaccggctcctccagatgggccagagccacagtgaccgtgttgtccccctcaaagggcacacgccctgtgaccatctcatacatggtgatgccaaaggaatagatgtcgctgcgctcatcgcagtagccgcccctggcctgttccggtgagatataatggacagagcccactgccgtggcgttcatggtctgggaggacacggccctggcaatgccgaagtcagctaccttcaccttgccgtccctggatataatcatgttctggggcttgatgtcacggtgtatgatgtgctgttcatgggccgccgctatgccctgtcccacctggagtgcgattccgatggcttccttgctctccagataccctttattctcgatataatttttaagagtgatgccctcaatcagctccatgacaatataatggtatacatcctcatccacaacatcatagacactgacaatattgggatgggacaaacgagctgctgactgggcctccatcttgaatttactcacaaaattctcgtcaaaggcaaattcctcttttaataccttgatggcaaccagacggtccagggtatggcaccgcgccttgtacaccacggacatgccgccagagccaatccgttccaaaatctcatagcggttctgaagatatgttccgggagttaacatatgcccgcctcccttcccgacggattcacaagaaccaccgcaatattgtcaatgccgccctgacggttggcttcctctatcaaaagggctgccttttccttaagacttccctctcctgtgacgatttcatacatggcctggtcctccagcatattgctgaggccgtcggagcagagcaggatataatccccgtcctccaaatccacttcaaagaaatccggctccacttccctgccgattcccagggccctggtgatgatgttcttgcgcctgttataatcctcgcttccccttttcatctgtccgatggccaccatctcctccacataggaatggtccctggtaacctgccggatggaatcaccgtgtatgagatagagacggctgtcgcccacattggccacatagaggatgttgtcctccaccacgccggccaccagagtacatcccatccctttcagttcttccctttttaatgattcttcatacagcattccattcactgcctcaatgcccttttttaactgcatcacaggagagccgtcccctgccctgtttatgtatatcaccagattctccaccgcaaaccgtgaggcataatcaccggccctgtggccgcccatgccgtctgccaccagaaacaggtttggcagggagcccaccttttccggtgaggcataaatatagtcctggttcatggtcctgacccggccaatgtctgtcaaagcatatgcttccatggtcatccctctccttccgtgcattgtggtgccgcagaagcttccttatagcttctgcgcagctggccgcaggctccgcctatatcccggcccatttctcttctaatagtaacatttataccgtttttttcaagaagatttttgaaatcctgtatggccttctggccggactggacgtaatcccgttccttgatgggattcaccggaatcaggttcacatggccgtgctggtcctttataagctttgccaaagccctggcctcatccagattgtcattgaccccccgcaccagactgtactcaaaggtaagacggcgtccggtcgtttcgtagtaataacggcatgcctccagcacgtcctgtaattgatagctgttggctatgggcatcagggtttttcttacctcgtcattgggagcatgaagggagagcgccagtgtcactgccatgccctcctgtgcaaacttttgaatacccggaacaatgccgcaggtggagatggtaagattccgctggctgatattcagccccttgtcatgggaaataagccgcaggaaacggatgacattgtcatagttatccatgggttctcctgaacccataaccaccacattggagacacgctcccctgtaatggactgaatcctgtatacctgttccagcatctcggagggacgcaggttccgttccaggccgtccagggtggaagcgcagaacctgcagcccatgcggcagcccacctgggaggagatgcagacggaattgccgtggcggtactgcatccacacgctttcaatcacatggccgtcctccaggccgaacagatacttcctggtaccgtccacctgggaaatgcgctcttccaccatcttaaggcaggtaagtctgtactgctccttcagtttctgccgcaattccttagaaaggctgctcatatcgtcaaatccttccgccagcttcacatgcatccagtcataaagctgttttgccctgaaagatttctctcccagggccgccatctccgctgtcacttcttccagtgtcatggattttatatctttctttccattgcagtccaataaatccagcataaaaactccttccaaaaccacctctaaataccatcccggcccggttcactgtccatgcgtctgaatacgctgataaagaacccgtcatagggatgcactcccggaagaaactgaacccatccctcctttaatgagggctccttgggcagtccgtcaaaccggtccgtcaaatccaccggttcaagagggaactgttctcttaaccaggcagcattgtcctggttttccagcctgtcaatggtacaggtgctgtaacagagaagccctcccggctttacatactgccagacaacagacagaatctgccgctggagtcctgccagctcctccagcttttccggcgtcatattgtacttaatgtccggctttctccctatgatgcccaatccggaacagggcaggtcggctatgacaatatccgcctttttaacagccgacaaatccggctccagggcatcccataccagggtcttcatgttggtcacgccgcagcgggccatgttttcctcaatcagggctgttttctgatatgtaaggtccctggcttccaccatcccggtgcccctaagcttatctgccagatgaaggcttttgcctcccggggcagcgcatacgtctatgatataatttcctttttcaggggatgcaatctcccccacaaaggctgaggtcacatcctgtacctgtatccagccctttctgaaggcatccagtccctccaggtaatcatacccgtcaatggctatcatggactccatgaagggcagctccgagaccaatgttccctggtcccttagggaggccaggatacgctccctgtccgcccggtgcaggttgcatctgacccaggttggcttatcctcaagaaaagaggcggcaatcttctccgccttctcctttccaaactccttttcccacatgccgtacatccactgagggatactgtagcgcagggagggagtgtcaaaggacaaattctccttttccctggaaatggtccgcagtacgccgttcacaaagcccttaagcccggaaaagtgacgtttcaccgccagcttcaccgcctcattgcagacagcggaatccggtacgcggtccatatataaaatctgatacacgctcatccgcagaagactgcggataaagggtttcatcttattaatcttagtcttggagtacctgtttatgacctcatcaatctgaatcaggtattccagggttccttccacggcacgggtgataaaggaccggtccgccttgcccaggtactggtacttctgcagtgcctggtttaagaccagatggacaaaagccccctgttccagcacctccgtcaatatgtccaggacaatttcccggttttccagtcctctgtctaaggtctttgccatctgaattttctcctctcagggcctgtctgaatataaatccccataaattctcccggaccctgcgccttaatcattcctgcggttgccgaataatatgagcaggcggagaagctggagaacggatgccgccgctgccgccacataggtaagggccgctgcgttcagtaccttcctggtctgtcccacttcctgcccggccaatattcctgtggaatccagaagagccaccgccctgtgggaagcattatactccaccggcagagtcaccagctggaacagcactgccaggcaaaacaaaaggatacccagattcaaaagaacagagcttcctcccagcaaaaggccgatgataatcaggggccagctcagctgggcgcccaggttggctgccggcaccagggccgcgcgtatcctcagcggagaatagtcattggcatcctgcatggcatggccgcactcatgagccgccactccgatggccgcgatggatgtggaattatacactgcatcggacaggttcaccgtcttgcttctggggtcatagtggtctgtcaggttgcctgccacacggcgcacggtcacgtcatagattccctgattggccagaagccgtttggcggcttcagcgcctgtcatgccgcacatgctcctgacggagctgtaacgctgatacgtggagttaagcttggcagaggctgccatggatatgataacgccaatcaatatcagcacataggtggggtcaaaataaaacatagggtaaaacatcatcaatcactctctttctttacaaaaacgtccccctccgggataggatatccgcggagaaaagctggggtatccatgcgtttctttccttccatctgaagctccctgacggacagcaggccgctgcccgtggaaaccaccaggctgttcttatccgaacgcaccacggtgccgggaaccatccctgtttctgccggtaatcctgattcagccaaaaggtcatccgcctcccggcctgtaaccgcatccgccgaccatatctttattgtcttcccattccacagggtatatgcactgggccatggatttaatccccgaatcaggcgttcaatggacaccgcgccctgattccagtcaatgtcgccaagggactttgtcagcatcctggcgtagcaggtgccctcctctgtctgtggggtacggaccagtgtgccctgctccagctttgcaagggtggataaaatcagttccccgcctgcctgggaaagcttgtcatgcaggctgccgcccgtctccttttcttcaatggggattactgtcttttccagcatgtcccctgtatccaggccagcgtccatcatcatggtagtgatgcctgtctctctctcaccgtctatgacgcaccactggatgggtgcagcgccccggtacttcggaagcagggacgcgtggatattgatgcagccgtacttaggaagctccagcactgccctgggaagaatctgtccaaaagctatgaccacatacacatccgcctccatgccctgaaggacttccacaaaggaggcatcacgcacctttgccggctgatacaccggaatgccgtattccatggcctgtatcttcacaggcgtcatctggacttcctttcccctgcccctgggcttatcgggctgggtcaccacggcaattacctgatgaccagcttccaccagtgccttaagggctggcacggaaaaatccggtgttcccataaatacaatgcgcataaacctcactcctattctgtgatttcttcctcatcggcagcggtatccaccagttctccctccaccagctccacatacatctggccttccagatgggcgcattcatggcagatggccctggccagcaggccctcgccttccagctcaaacggctccatattttcattcagggccctcaccttgacatagttggggcgggtgacaatacctgacttgcccggcaggcttaagcatccctcataaccggtctggctgccttcggtggctatgatttccgggttaatcagtacgtactggttcccgtcgtccacgtcaatggttacaatctgcttcagcactcccacctggggtgctgccaggccgcagccgttggcctggtacatggtctcaaacatatcttcaatcagctccatggtgcgctcattcatcgctttcacaggcttacacttctttgtcagaatatcgtctcccataatccttatctgtcgaactgccatctcttctcaatctccttcatcatgttaaatcgtactgcacagtcagtccatcacggccttctaatcccttcaggccctcttccgtcattttcctaatctgtatcagtatatcataattttcatgctttatatataaaatttttctataaatatcattaactttgtataccgctgcattgaccggcccaatgagccggaaggacctgtatccctgtattttttcctgctccatgcggtccgcccactgctgcacccatcctgccgccaggtccgctgtctgttccagcgtcccttccagagggcaggccagctggatggtaagcagtgccactgcgggaggatatcccagcagccgtctgtaagccatctcctggccgtagaagctctcataatcctgggtagctgccgtgcggatgctgtaatgctcgggctggtaggtctgaatcaccacatttccaggcaaatcccctcttccggcccggccggctgcctgggtcagaagggcaaaggtctgctccccgcaccggtagtccgaggcgtaaagggacaaatccgctgccagggctcccaccagggtcacctttgagaaatcatgccccttgacaatcatctgggtgcctataagtatatctgcctctcccctggcaaatgaagatagtatctcctggtgcccgccttttttggaggtggtatccaaatccatccttagtatcctggccttagggaaaagctctgctgccatggcttcaatcttctgggtccctgtgccaaagggcgcaatataaggcgagccgcacacagggcattttttcggctggggaatggtatacccgcagtagtggcacatcatgcgcccgtcccggtgcagggtcagggtcacatcgcagtggggacacttgacagcctcgccgcaggaacggcaggacacaaaattcgcatagcccctgcggttgatgaacagcatgacctgctcccttttttccaggcgttcctctatcagctccttaagacgcctgctgaaaatggaacggttcccctcctttaattcttcccgcaaatccacgatttcaacctggggaaggcaggcgtcctccttagccctctccttcagggtaaacagcccgtactctcccctcaaagcccttgtataggactccaaagaaggggtggccgaacccatgacaagggaagcatcattcatccgggcccgcctggcggctgcttccctggcatcatagcgtggggacagttcgctcttataggcattttcatgttcctcgtcaatgataatcagccccaggttttcaaagggggcaaacagggcggagcgcggtccgatgacaatatcgatgtctcctgtcctggcccgttcatactggtcataccgttcccctgcagacatgcgggaattcatcaccgacacccggttgccaaagcggctgtaaaaccgcataacggtctgccaggtaagggaaatctccggtatcagcacaatcacctgccgcccggctcccagcacatgggcaatcagctccatgtagacctccgtcttaccgcttcccgtcaccccgtgaagcagataagtccgccggattccccggtcatactcccctgtaactgcatctgcaatctcctgctggaaaggattcaggtccggcggggcgccccacaggccggttccctctgccgcccggctatccgctgccgtccgattatccgtcgcccggttatccgctgcccggttatctgccgccgcacggctcctatcaccgccccccataagcagcttcatttcctccaaaggattccggtatttctccaccacctccacggcaatgattccggcctccaaaagaggcttaatggctgttgctgtcaggctcagccggttcatggcctcctcatagggaatggctccgttctgaagcagggcttctaaaagccgcagcttagccttatgcttcttccgtccggcctcctccgccagctcctccagcacgcccctgccaaccagggaacggattctccgtttaggcgcctccctgaccttctgcttcacaggcagaactgttttcagggcctgattcatggtggagccataccgttccttcatccaccaggccagccaaataagctgggactcagcaggcacgcttccctgcacaatcccagccacatcttttaatttatggacatctatctgagcctggtctgtcagctccaccacatatcccttacgctgccggttgccctgtccaaagggtatgtaaacctgctgccccacctggattttcccctgcagctcctccggtattttgtactggaacgttctgtccacattttcgtgggaaatatctataataatactggcatatctctgcgccactcacttcacctgtctgtcctgatattttgtactttggttattatacatgagaattcagcaaaatgcaaatgggacggggagataggcaaacacggacaggaaattttatccgagggagaaaggccgacatggattactgtattgcattttacttttggaatatgtcaattgcatggcttgtgatgcctgtcaggtccccgcgttcacaggtggcatagtggtatttcaggtataattcaaatgtctcatcgtccatcttatcaattgcttcgcgcatgagcagggcgcagccgtccgctgcggcatagtgcaggcgcgttgtggggaatacggacatcaaatcgtcaatgtcttctttgcgtacaagttcaaacaggtcctttggttcggattttgcggcaaaggtttcggggtcaagcaatccccttttaatgtattcagatacattgatgctgctgcggttgaatccttcgtccaggagacatccgtcggatataacgtatgcggctatgattacgcctccttgttttgtgacgcggatagcctcccccagcgcctggcgcttatcttcctgattataaaggtgatataagggtcctaacagcagcgtaatgtcatattgattgtccggaaaggcggataaatccaaagcattgccctgtgtaattgttacatgttcctcgggccgtgtgtgtttgcggaatacttctatattatgggggaccagttccactgcgtcaacctgataaccctgacgtgccagcgcatgggaataccggccggtccctgcgccgatttccagcacccggctgccgggggttatgtatgcttcaatgtagcgcatggtggtaagaaattcaacggcgccatgcttcatgctcagacggctgtcctcgtcatagttattataaaaatcaatgatgtactgatttgttgtcataatgcacctctgtttcaacctgattgtgatataccgctaagcagataagctccagtccggcttttcctgtctgatgagagctgtcagcatatttgcgaccattctttcaatgccggtattatctaataatatcttctgccctgctgccaggaccgctatgccgtgagaataaaggaataaatctataaatattgcccttgcccgctccggctcaactccaattatctctgcaaattcccctgcccgcttttcattgcctatctccttatagaaatcaccgggctcagccatgttcagattcatatcgcttataaagagcagcttgaacagatgcgtctcttccttcgcaaattcaatataggaaagcggaagaaccaggcagggttttacgccttcagacctgttaaagccagcaacatactgactgtaataatcataagcaaaatcaagaaattctttttttaattcttccatgttcgcataacatgtaaaaatcggacgcgtagaacattgtaatttacccgaaatgctcctggcattgacacactcaaatcccgattccctcgtaatatctaaaaccgtttttaatatcatttcctttgttatctttgctttgggcggcatattgttacctcgttcatctcaaatcacaatagttatataacatatgttgcataactattgttgcataaaatgcagcaaatgtcaaccggttttacaacaaaaacagcacagccagtaaggctgcaccgtttcacaaaagacaatcataccacttaatactgttttacaactgtcccaggcaattacctgtccctcaaccccataagaaaagggcaataactcccttactgcaatctttttcaatttcccgtccacttgaagaatcacatcacattccggcgtatcatcattttaaatctgacggcagttaccgcagggaggtatgatttccccgccctccttaccgcggaccgccgcaatggttatcaattccctttcaccatgcgaatctcactccacaacccccgctcttctctcaaaccccttaaaccgtcctgaaaacaagattgcccggaatatccagtcaatgaacatgccgtaccataccccggaaagtcccaggccgaatatgtatacaaagaggtatgcaaatccgattcggaatacccacatggagaacacggacacggccatggtgaatttggcgtccagggaagctctcagtgcatgggggatggtgaaggccaggggccatataatcatggcaatgctgtgaatcagaatcagctcccgcgccatggcggctgcccgggaggacagatgatagattcccaccagttcggcggaccagatgaccatggctgtgctgaatacggccaggattccatataccaccagtataagggatttcgtgtaatgcttggcctcctttaaacgtccggcgcccacgcactggcctactatggttaccagtcccaggccaatggcatttcccggcagatagaggaccgtcaccaagttgctggcaacggcaaagctggctatggataccgtacccagggaagacaccaggctctggaggaatatcttgccgaactggaacataccgttttccagcccgttgggaatcccgatggacagaatgttcttaatcatatgacggtccggaatcaggaacttccagctgttgagacggatggagttgttccggttctggatgaggacaaacatcattaaggcagctgccacacggcttataaaagtgggccatgccacgccggacacgcccatcttaaggccgaatacacagattgcatttcctatgatgttaatcatattcatgacaaaggaggtcatcatggatacctttgaattgcccatggagcggaacagggctgtacaggcattatagagcccgataaagggataggacagggctgtaatccagaaataggtctgggcgttgtccatcacatcctgttccacttttccaaatatgcctcccagcagatggcggccgcctatcagggctatcccggcaatgacaacagacaggagcatggtcaccagcaccagctgtccggccgccttcctggcatccctgggctgttccttgcccaggtactgggccgatatgacggctcctcccgtggccagggctcccatgatttgtatgattaagacgctgatggaatccaccagggcaacgccggacactgcggattcccccaccgcggccaccatcaccacatccaccatgcccaccagcaccgccatgatttgttccacaataaggggggccagcagctttatcatttgttttctggaaaacatatcttaccttcctctttctctcttaattccaataaatacccagccgcggttcctaaaagggatttctccctctcagggctgtggctgggtatccggaggacaggctcccggcccgtcctttattatctttgcgcatgcctgccttgtgcctgtcaccgcctattggttaccgtagttaccgcatatcagccgcctgcttcccaacacacctgtcagcccatttcatagcttccggagcccatggccctcatggaggtgctgtagaaccgctttgaagcccgaatcagatagcaggtatccttgattcccactgtctcgtacggggaatgcatggacagctggggcaaaccgatatccacggtgttcagggccacatggctgttggagatattgcccagggtggaaccgcccgccttgtcggaacggttggtaaatgcctggcagggcacgccctcttcccggcacaatgtcctgaacacagcggctgagagtccgtctgtggcatactgtgtgctgtatttaatgacaattccctcattcatatagggacggtttaccgggtctgatttgtcaccgtggttgggatgggccgcatgggcattgtcagcggaaaccatgaagctggaagcaatggccatcaggtattcttcctcacttcttcccatggcgctgtttatccgtctcagcacatcctccaggaaggtggaatcagccccctgtttggtcaggctccctgtctcttcattgtcaaatacagcgtgtacgctgacacaatcactgtggccgccttccaggaatcccttcagggtggagaatgcacactgcaggtcgtctaaatggccgcaggacaggaactccccgcctgcgccccagatgctcccgggtacacggttgtaaaggtacaggtcatggcccaggatatcctcctttttgaccccggcgctctcagccacggtttccatgaaggttccctttgcgtccgcaccgccgtataaaggcagcatatccacctgtgcgttatacttatatccgtcattgacctcccggttaaaatgaatggccagattcggtatcatgagcaggtcacggtccacctttaccagctttgtcacaatgcggtttccgtccctcactgccagacggccggccacggaaaggggacggtcaaaccagggagcgcacagcataccgccgtacttttccacgttcagcttcacatagtggttttcagcctccatctccggattttccttgattttaaaggagggggagtcgctgtggctggccatgatttggaatccggaaaatgcttttcccggtaccttaaaggatacgatggaggaaccgtttctggtcacatagtaggaaccgccctccttaagctcccacttctctccctcatggagctgcgtgaagcctgcctcctttagataatccgcaatggactgtactgcgtggaagcaggtggggctattttcaagaaaaccgatgagttctctggctgtacttaaacagtcttctctgtctatattcatatgatatctcctttgtctctttatttctcctctactgtaccataaacgcacccccggggcaatgcaggcagcctaactttttttctcctttgctgccatccatggcataataaatccaagtcctaccagtacaaagggggttacaatgttgagggccagctggaaggggtcttctgagtatataccggtgaggcatgcaaaggccgtaaatataaaacaccagccgcccaccaggataccggctgttttacccttcacaaaccggtattcaccgcagaatgcatctccggcccgtttcaaggcaatatatgccacaaaaacccacagataacgcagaggcatgcacacggagttcaccttgacaagccagcgcaccagggcgtccacgttccggatgccaaaggcaggaaccacaatcagtacgcagacaatgagcgtcaccagccggtggccgttcacataggtgccgtgttcatttttctcaaacatcctactggggatgaagcgggaatccgcactgtccagaagcatgcgcagaggcgcgtccacggacaggaccatgacagagaactgtccaatcagattggtcagcgcatacaccaccacaaagaagttgcccgcatggtaatattcacccagcttctggaaggcgtagtaagcgccgttggtcatcaggtcctgggggatatggccggagtcaaacatcatgcccagggcaatggtgccaaggatggctgtcacggccaccatggctgcaagggctaccatgccctttgcaaagtcccgggaagggtccttcatcttgtttacatagggggatatcttctcgcatcctcccactgcaaaaacaaggatggaaaggctgagaaaaaaattggcgttaaagtccggtataaaggaggacggggaccagtcaatggctaaaaaggagccgtctgtcagaaccggggcagccaccatcatgacaataaacagcatggacatgataaacatggccgagcctgccaatgtggcaagacgctttaacacgctcatcccctttccggacagatacatggcaaacaggaagatgaccaggcacaaaatctgcatcaccgtggtgttcatgccgctggccctcttgtcctgaaacagggcccagctggctgcaatcactgtggaattgggcttctgggagatatagggcatgtggaccacccagtaggtccagcccgcgtaataggccatcttaggccctatggtctcatgaatccaggagctgaccccgcctccggcatgcttaaaggtagagcccagttcccccaccataagggcataaggcacaaaataaatggcaaatataagaatccaggatacaatggcctttaatccgccgtactcagagaatccgtttattacatttccaaatccccagaccgttgaaaaggccatgaaagccagggtatgccagagaatcttcttatcatctttctgctgcatcacaatgttactccttatctcattcagaatgtactgtctgtgacatttctgtccatgaaatacattcttcccaaaatgagggaaagatatgagtgtgcagtttgaatcatgccctggtttccttcagatgcttcactgcaccggacagcttcatgctgttggagcctttaaacaggacgcagtcgccctccttaaggttctcatccagccacccttctatccgggccagactgtccattttgaaatagggcgtcgctgcatgggatgcttccattccgctgccaatggcggctgccagttctcccagcaaaagtaccgtgtccaaaggatgctctcctatgtacccacctatttcccgatggaatctgaccgcgtcaggacccagctccttcatgtctgccaggactgcaatcctgcggccttctcctgccacggaggacagcacctccagtccggccttcatagacacggggctggcattgtagctgtcgtcaataaccgtgactccgccccacttaaatatctgctggcgtcccttatagcccttaaactgccccagggcaagggccgccttctccatggaaagcccgtatgtatccgccactgccagggctgccattgcattgcttaccatatggcttcccataacctgaagccgcacccgggtcctgctgttcccgtggaccgctgtgaacacaggatagccgtcttccaggtgcaggtcctctgccctgtagtcacagtcctgtcccagtccgtacagcaccttcctcctgccttctccgggaaccacggaggccagaagagggtcgtcgccgtttaagaacaaggtgccctctgagggcattccgtcctggatgtgcagcttttcctccaggatgcgttcctgggacccaagctgttcgatatgggtcacccctatgttggtcatgacggcgcagtccaccctggccaccctggcaatgcgctccatctccccgggctcgctcattcccagctcaatgacgccaatctcagcggactccggtatctctgcaatggtaatgggcactcccacctggctgttgctgttgcccggcgtcttatacaccaggaatccggcgcccagggccgctgctatcatctccctggtagtggtctttcccacacttcccgtgattcccaccaggggcaggataaggcggttcctgcaaaagcttcccaaattctgaagcgctcttttggtatcaggcaccttaatccaggccgccccaagggctttctcctcctgctcccggttgcccgcgcactgctgccgcacaaaagcctccactgcctcactgctgcagtgttcactggtaaatacaactgccgccccgctcacgattgcctggcagagaaagccgtgggcatctaccttttcaccgacaatgggtacaaacaggtcgttcccttccatttttctggaatccagactgatgtgttctgcctcaatatcctcccggcccagcaaaaggattcctcctgtggcctcaaggagctccttaaccgttattcctgtcatactatgcctcgtctcccaactcttttatggtttcttcaatgacttccctgtccaggaagtgatggcgcacgccgttgatttcctgataatcctcatggcccttgccgatgacagctaccatatcccccggcactgcgtgcaggatgctgtggcggatggcatcccgcctgtcgggaatctcaataaaggccccgcctgttttctctatgcttccccggatatccgccatgatatcctccaccttttcatatctggagttgtctgccgtgattatgcttaaatcggccagcctgcctccaatctcacccatagaataccgtctgtccttggaacggttgccgccgcatccgaacaccaccaccagccgtttgggatggtacctgcgcagggtggtgagaagactctccatgctcaccgcattatgggcgtaatccaccagaaccgtacacctggatgaggtgtggacaatttccatgcgtccattgacccgtatatgctccagggcgtgtactatcctctcctttggaagtcccagaaagctgcacacgcacagggccgccagggcattgtccacattgaagaggcccgggattcccaggcgcacatccaggtccagttttcccgtaacgtcaaactccgtgcccacaaaatccggctgtgacacataccggatattggaagcttcaaaatcagctttcttttccccgtcttcctttacgcggtaggtataaagcctgcaggacgcatcccggacaatttctgcaaaatgtccgtcgtttaagttcaccaggcctatcctgcacatgctcagaagccgggatttgcagaaaagatattccgcaaaatcagcgtgttcatccggcccaatgtggtccggggaaatattggtgaaaataccgtagtcaaaggcaatgccgtccacccggtgcatcttgattccctgggacgacacctccataatcatataccggcagcctgcctccgccattttggcaaaggactggtgcagttcataggattccggagtggtgttcatggtaggcgtcacctggccgtcaatgactgttcccgtggtgcctatcatccccaccttttttcctgctgcctcaagaatggcttttatcatatgtgtggtggtggtctttccctttgtcccggtcacgccaatggtaatcattctggaggccggatggccgaacctggctgctgagagaagggccaggcttctcctgccctccgctgtcttaagtattgtcacctgtcccatttcctcctccgtaagtccggaggccgccagttcttcctcaacatcccgttccgtcacaagcacgcggacgcctgcccgcagcacatccgggacaaaacggtgggagtccacgcgggtccccgccatacacacaaacacagcgccgggcgctgcctttctggagtcatagaccacctccgtgacttccacgtccaggcttcccctgacaagttcataatccagctcatttacccaggttctaagtatcatataaattcctcatttctttttcatgcaacttattttatgcccaaacctatcctggcccggcgctcctttcttggatgcgccgggccaggccgatttcctagaagagtccggtaatcttaccgttctcatccacatcaatgctgtctgccgccggtttctttggaagtcccggcatggtcatgatggaacctgtcagcgccaccacaaagcctgcgcctgctgacacataggcatcccttacattgatggtaaatcctgtgggacggcccagcttggtctggtcatccgacagggaatactgggtcttggccatgcacaccggcaggtttccaaagcccatatcctcaatgcgctttaacgccttggctgcggccggtgcaaaggatgcgccgtctgccccgtaaatctccctggcaatggtattaatcttatccttaaggcccatctcatccggatagagcacatggtactgggtgggcttgttctccagggtctccattaccttttcagccagggcaataccgccctcgccgccctttgcccatacctcggacagggcgaattcacatcctctgtcctcgcagaacttcttgatataagcatattctgcctctgtgtctgatatgaaggaattgagcgtaaccaccacgggtactccgaacttctggagattctcaatgtgcttctccagattgacgatacccttctccagagcttccaggttctcagttgaaagctggtccttgggcacgccgccgttgtacttaagggccctgactgttgccaccagaaccactgcgtcaggcctcagtcctgccttgcggcacttgatgtcaaggaacttctccgcccccaggtcagcgccgaatccagcctctgtcaccaccacgtcagccagcttcagggctgtcttggtagcccttacgctgttgcatccatgggcaatgttggcaaacggaccgccgtgtaccagggcgcctgtgtgctccagtgtctgaatcaggttaggctttaaggcatccttcagaagggctgccatggagcctactgcatgaagctgctcagcagtcacaggctctcccgcaaaattgtaagccacgataatcttgcccaggcggttctttaaatcttccatgttgtcagccaggcaaaggattgccatgatttcggaagccactgtaataacaaagtggtcctccctgaccataccgtctcccttggctcccaggcctaccacgatatttcgcagtacacggtcattcatgtccacgcagcgtttccactgtatctgccttgggtcaatccccaggacgttgccctgctggatatggttgtctaacagtgctgccagcaggttattggcggatgtgatggcgtggaaatcacctgtaaagtgcaggtttaaatcctccataggcacaacctgggcataaccgccgccggctgcaccgcccttaacgccaaagcagggacccagggacggttccctgagcgctatgatggcctttttgcccatcttcccaaatgcctcgcccagaccaaccgtggtggttgtctttccctctcctgccggagtggggttaatggctgtcaccagcaccagctttccgtcgggacggtcctttacctgctcccagagttcatctgtcagctttgccttgtatttaccgtaaagctccaggtcatcctccccgattccgtaagcagcagccacttctttgatgggctgcatcacggcctcctgtgcaatttcaatatctgatttcatgtttttgttcctcctcttatattacgccccgcggttccctgcctttgcaggtccgtcaacgttttattcaaaagcaccggccgctgctgcccttgccggcagccgctgctcttgtttccccatacactcctgtttcccggtcaggccatctgtaccgccctgccgggcagcaggctttaatatccctgctccagcagttcctcgaattcttccatgctcataagcaccttcctgggctttgtcccctcttcctcgcccaccacgccggcttcggccagctggtccatgattcgggccgcccggttaaagccaatcttaaacatcctctggagcattccgatggatgccttttccttctcaatgatgaacctgcccgcctggacaaagtattcatcccgttcagctgccccgctgcccccatccatggacggggatgagacgcggctctccacttccggattatattcagccaccatgccctgttctgtcaggaactccactacgcggcccacttcctcatcggacacaaaggcgccctgcacacgctggggcttggggaatcccgccggataaaagagcatatcgccctttcccagcagcttctcagccccgttcatatcaatgatagtcctggaatccacacccgaggacactgcaaaagcaattctggacggcacattggccttaatcagacctgtgatgacgttaaccgacggcctctgggtggcaataaccagatggattcccgctgcacgggccagctgggccaggcggcagatggaatcctccacttctcccggggcaaccatcataaggtctgccagctcgtcgatgattatgacaatctgaggcatctttgccggcttcttgtcatcctcaatatcctttatcttctcaactctttcattgtagccctttaaatccctgacattgcactccgcaaacttcttatagcggtccgtcatctcagccacagcccagttcagggcccctgatgccttcttggggtctgtcaccacagggatgagcagatgggggattccgttatatacactgagttccaccaccttggggtccaccataatcatcttcacgtcctctggtttggacttgaagataatactcataatcagggtgttgatgcataccgacttaccggagccagtggcgcctgcaataagcagatggggcatctttcctatgtccgtcaccaccacctgcccgccgatatccttgcccacagcaaaggccagacgggacttgtggtttttaaaagcctccgcctccagcaaatccctcaggtacaccatattattctctttgttcggcacctcgattcccactgccgacttgccggggatgggtgcttctatacggatgtccgcagcagccaggctcagcttgatatcatcggtcagtcccactatcttgctgaccttcacgccctgttccggcagaagctcataccgggtcacggcagggccgcagctgatgttagtgaccgtcacgcccaccccgaaattgtgcagggtctgctgcagctttatggcagtggccttgtactcatccccagagaaggctccggcattcttggcccccttcttaagcagggtggtgggcgggaacacgtattccttcttgaccgcctcttccttttccttgatttcctgggccaccgccagatttgaatctgactgtttagcctcctcccgcttcttctcaatctttttctggagaagctctgtctcagtctctatgaccttgcctgaagccgtaaccacccgcttaggctcctccggcacaaatacgctgtcataattgatcccctgctccgaggcgtctgtctcatagatatctgcttcacagatatctggctcacagatatccgaatcaccggtatctggttcacggtcccctgctccggaccttcctgctgcatgagcaccggccgcaccttctgcagccatggcatccgcctgcgccatattcccagaggtcccatactcctcctcccagggaaccgtatcctcacggccatggccgctgtccgcatcccggcccgcggatgtcccaatgcccagctccatctcttccagggtctttaaatcctttttcacatggatggtgtcataatcatatgcatcgtgtgtcccatactcgtcctccacccggataccggtaaccaccggtgcatcatccctgcgcccggtacggctgtgtccctctatggacctggccagggctcccacatcgtccgtgtcataggagtccccgtcatccatagccgcaggctccaaaggcgggtcgaacctgcccacaaactcatccggcggaaggatatcctttgcgccggctgtctgggccgttccccagtcctcctggtatgtatcgggcatttccggcattttctccaaatccgcgccgaactcccggtcaaatgcttcctcgtcgtaatcctcttcctcaggcgtcatcagccttgtggcattcaggttcacgccccgcaccctctgttcctcgcgaatgcgcctgcgttcctcctcccgtatggcatggagctccctgcgcctgtccatatcctccctggcatactgataggctttgtcccctccccgcttcacagcagacacaaaggagcgctccgtgatgcataccatacagatgataaacaggaccaccagaatcaggaatgcccccggctttcccagtccgatggtgagaaaggaggtaagaacacccccaagccatcctccccccgtaccggtcagtgtggactgtttgtagtactccatccactttgcgccggcaggcactgttccaaaagccagctgcagcagtccgcagaccgtaatcacagcccccaccacggccgccagcttcatggcggcatggatgttgccctggttggacagatgaaaacaggtccccacaaatatcaggatgggaaacaggtatcccaccattccgaacactcccagctgcacaccgcggagcacatcgcccaccacgccgcacagcttaaaattgctgagaaataaaagaatggcaacagcaaaagagcagatgatgaccacttctgctctcatgaattccgtattatcctgttcataggcctttttcccggttgtcccacggctcttggcggaagtgcttgtcttcttggacgtacttccctttggccttcccggctttctgttcccactctgctgtcgttttgttgtttcagccacttgatacagcctcccgtcattctcttacaagttatcgtaccgtagcagcctcccattcccacagcaggctgtcttatttatacagttaacttatattatgctatatttgagatcaaaattcaagtggattgttccaaaagcctccaaaacccatagcgcatgtctgcgaaaaagggcctgaatcccgtctttggactttaacaccataattctttaggggcaattcaacacatcatatatttacagtcagagtagatactctcgtatctactttttcttgtaatacccaaagtccagaaagaacctattggccaccctggcatcttttctttttttagtaagctgccaaaatactagcggaacagcagaaaaacaacaaaccaaattaattgaatcctatttgcaagacttaaaaaacggtaatacggaggaggcttctacaaaggtccgatttacaaaagcagaaataaatgccggtttaccagatatattctgtgatgccatgcaaggatatgattataaagaattaacgattcatgaaattaaaaaactgaatgattctatttatcttgtaaatgccacggtcaatacaaactttgacagcgaggataaatctgaatatatcgatgttgaattcaatccttttattgtattctatgataacgaatataaaatcgcttttgtcaaagagcaggttccccaaagcttatatggagacttaaaggcactgccggataattatgatgataatttagactacatcatatttgaggatggtgatgaaacctttaacccagaatagatgtttatatttttattaagatgtattaaaatataaacaggaggttgtattgtatgggaaaaaaattatcaccaatggaatataagttcatggaatttatttggaaattcccccagggagtatacagtaacttaatatacgacgaatttccccaggcacagggcacaaaaggggctattttatttcatatcaaagaaaaagggtatgtatcagtccagcagaaaggaaagcagaccctctataccccgctgattagcaaactggaatatgataaaatggcaattaatatgaggttgaaggataaattcggaagcagccggttggaaaatctgattgcagcattatgcggtaaaaagagtttaacagaacagcaggtagataaattatatcaattgattgaagaactgaaagaggaggataatgattaattggcttgaactgatatttgttatgtcagttgtatccagtataatgttcggagctgtccttttaattgaacgcttttataaaactgaatacattgaatacgtatattttatgatgaaagtagttctaattatctttctaatccccatgtttatattgataacgaagattgtcatggacagcatggggtatactgtccatgatattcatggggaagatataatgagtgtcatttgttttaatcgctacaatgttgccatgcttccccatattcagactgctgcaatatgtatgttcgccatatggggattgggggctatcttaacttttataaactcttttatcaagggaaggcggctgttacatcatcttattaaaagctctgaaactatttcaaaaacagaactggactgcataatagaaaaagcaaaaacagaactggacatacgaaagctgcctgtgttatataaatcccatctcataagcacaccatttttgacaggaatcttcaatccaaaaatcatatttccaggcagggatttttccgaggaagagtgggacttaatgctaaggcacgaattgatgcatcttaaatcgaatgacttgttgtttaaagccatcattggcattgtacactgtatacattggttcaatcccattgtatatctatataaaataatcttttttgatttcagcgaatatgcttgtgacaagcgaacagcagcagcttttaactccagacaaaaatcgcaatatgcgggcctcatcatcagcctggccgccacaagaccggaatatgaacagacggtcacattcgttgaccgaaattacagggtgattgaaaggagggttaaagagattatgaaaaaaccaacaaaggaaaaaagtgcattattaatcggaacaatggcactttttatattactatgcccaatggccgcatatgctgctgcatccggagtaatggaagcccaatctatagcggtaaaaaatgagcttacgaaaaatattgaagagagcactatttttctaagccaggaatcatccgtaaacatgagagcagatgcagtaaaggtcatattagttaatcccagaggaattaacaatattgacatgtctctcgaagcaggcagcacatatatgtttgactctctttctttgaaaaagggacaggaaataacgctatcaatcgtatccgataagtcttccgaccgtttctcagtcagtatcactgataaatctggaaaaggaaaactcttctcatccaataaaggcatggtatccgctgcctataccgtccctcagaatggcgattataagatttatatgaacggaccaaatagcggcagcgacgatatccatatcagcggaacgatacggattgaatagtggacgcacagcagcacctgaatttagatattttacctgtctgtttgacaagggacatatcgaaattaacaggtgctgcatttttctatctgcaaatagatattacataatcctcacatttttaagcgccccggtcttggaaaactgggtccactcacacacattcacagcgtggtcgcctatccgttccagatattttgccaccatcagcaaatcaatcccctggtccgcctggtcaggggaggatttaagcagatgaatcacatcctcctttacctggttaaacagtgtatccacctcgtcatcccggtcaatgatttccatggcagcatccaaatcctggtcaatgaatgcctctatggcgtcatgaaccatcctgccggccgatgcagccataaccggaagatgcttcacaatgtggtatgcatgctcgcttttaatcctcagaatcagctccgcgatatccgaggcatggtcgcctatccgttccaggtcagtcaccaccttaagggccgtggacacctggcgcaggtcgctggcaacaggctgctggcgcagtatcagggacaggcatctggactcaatggcccgttccatgtcattgacagtccggtcgcccttaatcacatcctcagccatcgtataatcctggtcctcaaatgccgtaaaggtctgctcaatggcgccctccaccatgtgggccatctcttttaaatcctgcttcaatacttccaattcatgttcgtacgtaaccctaacactcaatctgattccttccttctgccatcatccgaaacggcctgtaatatagtcttctgtccttttatcctttggcatggtgaaaagttcatccgtagccgcatactccaccacctctcccaccaggaagaatgcagtgtggtctgctatacgtgtggcctgctgcatgttatgggtcacgatggccaccgtgtatttattcttaaggtcatccatcaaatcctcaatcttcagggtggatatggggtccagggctgacgtgggctcatccatcaaaaggacctccggctccacagccagcgccctggcaatacagagacgctgctgctggccgccggacagccccagggctgattttttcaggcggtcagagacctcatcccacagggccgcccccttaaggctgttctccacgatttcatccagcctggccttgctcttaatgccatggattcttggtccgtaggcaatgttgtcataaatgctcataggaaatggatttggctgctggaataccattcctattttctttctcagcagggtggtatccacctgggaatcgtagatatcctcatcatccaggagaacggtcccatctatcttaacgcccggcaccaggtcattcatgcggtttaacgtcttcaggtaggtggactttccgcagcctgacggccctatgaaggcagttattttatgttcatacaaatccaggtttatgtttttaagggcatgattttccccgtagtacaggttcagattccgggttgaaatctttgttttgctttccacgcttaatctcctttgctgattgaaatggtccgtcatatcctacgcccctgcttccacattaaaccggcgggacatgtattttgccagaccgttgattcccagtacaatgaccagaaggaccacggccacgccaaaggcttcgttatactttgctttctgcatgaacaggtagagctgtatggtaagggtgcctcctgattcaaatatttttgaaaacaggttctttggaaggtaatagccgcttcctgccgtgaacagcagggcagctgactctcccacaatccttccgatagccagaattacgcctgtaaggattcccggcatggcgctgggaagcagtatggtccgtatcatgtaccattttgtggccccgattccaagggctccatggcggtagctgtcaggcacggtcttaagggcttcctgggtggttctggttatgaggggcagaatcataatggtcagggtcagggctcctgtaagtatggaataccccaggcccagggcatttccaaaaaacaccattccaaacaggccaaatatgatggaagggataccggacaatgtctctgtggtaaactcaatcatgcgcaccacttttcccggctttgcatattcattcagatacacggcggagccaatgcccagaggggtggccataagcagggtgatgattacaatatacagtgtgtttataatatttcccaggattccaaaagtaccctttgtggcgctggaggccgtgcttaaaaatgcccaggttacatggggaattccccggacaaacacatagcccattatgcctgccagaagaaggatggaaaaaccagcgcagatgtagatgacaactgtaagaaacatatccaggccgcgtacacgcttaccgtatatgctgtcccggacaacagactcctcatggacccggactgcaatatcatttgtcattcctgtttcctcccctctttaaaatcctggtaaggcttacattgattatcatgatgaaggcaaacaggaccagacctatggtaaagagcacctgtctgtgaagccctgccgcataccccatctccgacacaatggctgttgtcaggaagcggacggagttaaagggaaggggcaggtttacggagcttcccgacacaaggctgatggccatggcctcgccgatagccctgcctgttcccagcacaacagctgttataatgccggatttggcagcaggcacaattacctggaatatggtctgtatctttgtggcgcccagggccagggaagcgctctttagatgggccggaacagacctgatggcggattcgctgatgttgatgacagtggggagaatcatcagggcaagtaccagtacagctgatatcaggttggccccgcctgtaaactggtgggtttcagaccccttaaacagtatcagctccagtttgtacatcagaggattgagaatcaggattcccagcaggccgtatatgacagagggaatgccggccagaagctccaccgccggacggaccatgtcgctgagccgtttgggagctacctctgcaaggaatatggcagtcataacgccgatgggaacaccaatcaggattgccagaaacgttcctgcaacagaggtcaggatgacaaacagtataccgaagctgggggaagctgcggcaggctgccacagggtcccgaacaggatttccagcagccccaccttaaacagtgccggcgtaccgctgataagcatatataatgtgatggaagcaacagccaatacggcgaaaaagccgcaggcagtaaagatgccctgtgcagctttttcgacggcggacttgctgccatgacaggaacgtatggaacatgtctccgctctcatgcaggaagtctcctttctctattccgattatttgtcaaccgcaatcagtccaacagacctgacaatttctgcgccttcatcggagtaaacataatcgaagagggcctttacaaggtcattctgcccgctaatatctcccttggtagccattacgaacggacggctcaggaaataggtgcctgccttgatgttttcctctgtgggctcggcgccttccagcttcacggcctttaccgtgtcatccagtacatccagggaaacatagccaatagcgcccggggtggaggccacctttgccatcactgcgccggtgctgtccagctcgttgctgtatttgcacatgtcttccagctttaacagttcctcaaatgcgcttctggtgccggaaccggactcccgtccaaccactacgatgggcgcgtcatttccgcccgcatccttccagttggtgatttttccttcatagatatcagacagctgctgcctggtcaggtcctccactgcgttggccgcatcaaccaccactgcaatgccgtcaatggctacaatattctcagccacaccgtcagccttctcctcatcttttaagttcctggaagagttgccgatatcggctgttccgttgctgacagcctccacgcctgcgccggagccaacaaattcagctgtcaccgttacattgggatatttctccataaaggattcgctcagggcattggcaaacttctccatagaggtggagcccaccatgctgatggtgccgcttaaatcagctgagggagcgctgccgtccttttccgcctctgcggctgtaccctctgtgccgccggcaacaccggatgtaccctcagatgccgggaccgtccctgctgtggttgcggcagccgctgtgcctgcgggcgctgcggttgtctctgtgccggtaccgccgcatccggccagtatgcccatggccagaactgccgtgcctaacagcgctgttactttctttccactcattctcatcatacatttcctcctgaatcatttcgtttattgtcatgtttgttcttatcttttctacagtttggagtatacataagatttacatccggagaaatcatgatatggtatagtttctgtaaaatgtgtgtaaagccgcagcagccgtccgctaatcctgcatgaatcattaacgtgcatccccgggcacggcaacgccaaaaggcacctgccgcgtcaaaaacagcaagtgccttttccatttaggttcattctatccgcttttattctgtccgcatcctgtctcagcctttacagacatcctccacaatgcgttccatctctccccactttttctccatatccgccaccagtccgaactgggtacggcagcggtccaggttgtgcttctccctggctgtcttaaaataagtgtcaccggacagataatccgccaggaaccggattccgcattccagggtcataagcctggccccctgaggaagcatcctgacctcggcctgggtaaggcttcccgcacatccctccagaaatccctttgtgtatgtctcaaagagagaaagggacagggataccttgcttaaatccgtttcatcctccttcgcggtattggcgccaaagcggatggagtctccaaaatcaaagatagaaagtcccggcatcacggtatccaggtcaatgatgcagatggcctgaccggtcttgtcatcaatcatgatattgtttaatttggtgtcattatgggtcactctcagcggaagctcccctctggccagcatatccatggccagccccatatcctgctccctgtccatgacaaactgaatctcatcccggacccctgacgcccggcggcagatatcctcctccactgcctttgtaaatgccctgaacctgcccggagtgtcatggaaacccggaatggtctctgccagctccctggcaggatagtgggacagaagcctctggaaatgtccgaaggcctttccgctctggtaaaaatcttccggcttttccaccaggttatagcaggtagctccctcaatgaagagatacatcctccagtaatttccctgactgtccacatagaatggggctccctctccggtctttataaggttcagcgtttcccggtccgggtcccctccgtttttaataacctcctgcctcaggaaggtggtaaccccctcaatattgtgcataagggataccgggtcccggaagatatccgtattcatcctctgaaggatataaggatggttctcacatatgaggcggaaggtatcattgatatggccgcttccatagcgctcgcagcttaccgccgcaccatctgtggcaaaggccgcggctgcctccctaagtatatgtttatcaatttctgcgctcattttccttattactcccaaagtttctccggatataatcccttatgcttaaggtccttaatggcgtttaccactgtatccttatcctccttataggtgaccccgtaccagcggtccacgctttttaagacagtcacctccgccaggcctgctttgagaagttcatccaccacaaagggaagaaaatactcacacttcatgggatttacaggcaggcttttatccaggaaggctccaaatctgttttccagctcgcccaggatactctttgtgaagccccacatgttcatggaaacaatggtggattccggaagctctgtccatgtggcgccgccgtcctccgtatattcagcctgattcccgtgtttttcaattctggtccgctcacggatatccaccagacggctgcctgcatcggtccggcacactcctcttgccacatatccattctctgtcagggtattgtacagtttatagcccaccatggtgtactggtaccggtccgtgtcctccacagaggccagctggtcataaatcatacggaaggcttctttgccataataatcatctgcattgattaccgcaaagggtccgtcaatcaaatccctgcagcaaaggactgcatggcctgtaccccagggcttcaccctgccctcaggcaccccgtatccttccggaaccttatccagttcctggtaaacataggccacatccatatatctgctgacgcggtttccaatgtgaatcttaaaatcttcctcaatggctttcttgataatgaatatgaccttttcaaatcccgcttccctggcatcatatatggaaaaatcaatgatgatattcccataggggtccaccgggtcaatctgctttaatcctccgtaacggcttcccattccggccgccatgattactaatactggtttctgagacatgctgtccttcctcctcacacaatacattcttatccctttacactgcctccggtcacgcctgctagaatcttttctgacaggaagatatacaggatgaaggcgggcaggaatacaatccaacagccaccggccgtaccttgccggagaagccttaggggcgttgctttgtctgcccatttaatcaggtcttccttataaaatccgtgccgcacttcgggcaatgcacacttaccttcccgtgccccctgggtatacgcactttttgtccgcatcccggacacttaaagacgcggtacttccggccttctgtaaaacggaatttaattttcctgaaatactccgttacatagaaccgaagacgcagatatacctggttttcctggtaacgctttcccacgttctttgaaaacatccgggcatacaggcagataatacccgccagctccagaaatcccaggaacggggacaatatccttaccctgacaaaagcatttaaaaaaatcagcacaagcacagcatacataatgaactggcccagctggtccataccatatcgtcctatcatgaaacgctggaatttttccctcaatttattcatctttaaacaatcctttcccaattatccggcctgccgccaagacgctccgccgcagccgcgaatcattcatccgagagtaactataacctaatttttgcgggaaagcaatgtacagccagggttttaatgattattttataaatacggacagaatgcctcctcccaacaaaatattttgccatcttgacattatataccctatcttctataatcaaaattggtcttaggaccgcattccatgttttagacatgataagagagaaaggcggctaactgaaatatgattattaaatgattgaacagcagcagataatttacacactcccttcccggactgtataaaacccgggcggattttgtgtgactttgtcatttcgttcagtcattcagggaatcatattccatacggccgtatttttgcataccgggatgtatctgtatatccatatacatccattgcagcggacaggcatgtcccggcaggcgcacacgcaacgccctgacctgtacattcccgttccttctgcgctcttgcaggccaggtttattcccttctgaacgaagtgcgttcaggagggtttttttttatgttattaaatgcactgaatattaaaaaagaatatggaatccagactgtgctggatatagaaaaactggaaatccgggacggggaccggattggcctcatcggacgcaacggggcgggcaaatccaccctgttaggcgttctgtccggaaggattgcctgcgaccagggcattgtaaaacgaaattgcgccattgccgagattctccagaccggagagacagaggatgaacctgaggccaggcttttaagccggttaaagctccgggacagcgcggtgaaaagcggaggcgagaaaaccagacgggccattggggccgcattttccagccaggcccccctgctctttgccgatgagcccaccaccaacctggatatggaaggcgtggagctgttggaaaaaatgatgggcggataccggggcgccatcctgatgatatcccatgacaggacccttttagaccgggtctgcaatcagatatgggagctggacaaaggagccctgcgggtctttgacggcaattattcggattgggcggcccagaaagaacgggaactgggttttcaggaatttgaataccagcagtaccagaaggaaaaaaggcgcctggaacgggctgccgacgccctgcagagaaagagccggaaaatggcaaaaccgccccgccgcatgagcagcagcgaatggatgctctacaagggcgtggccgctgtccagcagggtcatgtgcagagtaataaatcttctgttctgagccggctggagcatctggataaaaaggaacggccggatgagctgccccaggtgtccatgaagctgccggatgcagggcggatacgggccagaaatgcggcctcggtccggcaccttaccgtgcgctacggggaacgcatggtactgaatgatgtgagtctggaaatagaagcaggcagacgtaccttcatcaccggcaataacggggcgggaaagtccaccctaatcaaggccctgactgacagggtccctgaaacctttattacctccgaagcaagggtcagctatttttctcaggacctggacaccctggacccccaaaagacggtgctggaaaatgtggctgaggacgccgcttatccccggcacatctgccgggccgtgctgtccaatctctatatgacaaaggacgatatgttcaaaccggtcagcgtattatccggaggcgaaaaggtcaagacagccctggccaaggtacttgtctccggctgcaattttatgattctggacgaacccaccaaccatatggacgtgtataccatggagggtctggaaaaactgctgggaagctatgacgggacactgctggccgtcagccacgaccgtaccttcataagccatacaggggacgtggtctggcgtcttgaagggggaaccatacaaaaaggaaccttatagcgtgtttttatgtttcaggagatgccaaccgttatattttcttgacaataacgcttttccattatatgataggtttactataattatccatatggaggagaagtatcatgaaaaaaaatgtattggggattctactggcaggcaccatgggggccgcccttataacaggctgcggttccggttcttccggcactgcacagtcctctgccacgcagcaggcacaggaatcatccgctgactccgggcaggcaggggactccggacaggcagcggactccgggcaggcaaaggaaacagaggccgccgcttcaaaaaccacggaccttcccggcctgaccggccataccctgatgatttactgcggggcgggcatgaccaagccctttcaggaaattgccgacagctttaaatccgccacgggctgcgttatgaacgtaacctacgccaatgccggacaaatccagtcacagattaccacatctgaggaaggcgacatgttcatagccggctccgccgaggagttaaaaccagtggagtcctatgtatctgagagcaaggccctggtaaaacacatacctgtcctggcagtgcaaagcggcaacccgaaaaacattacctccctgtcaagtctggctggggaaggtattgccctcatcataggcgatgtggactccactcccattggaaagattgcaaaaaaagccctgaccgacgcaggcatctttgacaaggtacagatagaagcatccactaccacggcgccccagatggcaactgccattgctgcgggagaggccgacgcagccattatctggaaggagaactgcgatgcagcgggcgtggaaatcgtggacaacagcggtttggaggattacataaaaactatccccgcagcatccctgagctgttccggggacaatgaggccagacaggcatttctggactacttaaattcagaggatgcacaggaaatctggatgaagtatggatatgagattgcagaataaacaaaagaggcacaggggaacagacctgttctcggccgtgaccattgcagtagcgctgctggtgattcttttcatcggcagcgccatctgcgctattgcagccggcggaatttcctcctttgcaggaaccatccgtcagaaggaagtgctctccgccctgcgcctcagcgcggttaccgccagtctgtccaccctgattgtcatggctctggctctccccactgcctatgccctgacccggacctccatgccctttaaggagctgtccggtattatcattgagctgaccttgtccctgccctacctgcttctgggactcagcctgcttatcatgttttcatcgcctgcaggcaaatggctgaaggaacagggttttaaagtggtatttgctcctgcgggcattgtcatggcccatatcctggtaaaccttccctacgccatccggctcatccgtactgcctttgaggcgtctgaccagcggatggaattcattgcccggaccctgggagcttccccctggaaatgcttcctgaccatcctccttcccctctgccgcagaagccttgtcagtaccttcatcctgacctggtcaagggccctgggggaattcggcgccacccttatgctggtgggaatcacccggtttaagacggaaaccctgcccggcagcatttacctgagcatatccaccggcgacaaccaggcagccatggcaacagccatgctgatgctgatgatttccgggctgaccctctttctctcccgtctgctcaacagtcctgcggacaggagcaaaaggcaggtgtacatacgatgaatgaaatagttatcaacaatttttccgtgaaaagaggcagttttacactatcccccatctccctaaccatccagaagggggaaatctttgccatcctgggccgcacgggttcaggtaagaccgtactgctggaagccatcagcggcatgtttcccggcagtaccggcagtattctatatgacggagtcaacatacgggacataccgcccggccagaggaagctgggccttgtatatcaggactacggcctgtttccccatatgaaagtaagagaaaatattggctacgggctgaagatgcacggattttcaaaacaagagcaggagcgccgcgtacaggagcttatggaaatgctgtccatctcccatataaaggaccagtaccccggtaccctgagcggtggcgagagccagaggacagccctggcgagagctctggcactggctccccaggttcttttattagacgagccattttcagccctggacccggccacccgccgttccctgtatcaggaactgcgccggattcaccggcattttggctgcaccatcatcttcgtgacccatgatttcctggaagcccggacccttgcaggccgtgcagccatccttttggaaggggagctgaaaacagtcaccgacaccacacgtctcatggacggtcattttaccgatgaggtggaacggtttctgggaaggaatccgtgatattggatggggagtacggagcatgggtacaaattaattctgcgcccaagcgcaagaaagaaaagaggattatcacaatgacacatatcaatgatgcgccgtcattttacagagaattaaaatcacgtttcagggagctgctgacaaaagaagggattctgggccagcaggtggtaatcaataccaaatcccttacgcctgaggaagccattgggattaccgggcgaagggattttcccatcataaccggaaaggacgtgatggtccaggcagaatgcatgggctccctgggacaggcattcaccgacgccccatctgccttttgcggtacgttggaagaaatatgctccctggacctgacagaggacccccacagccgcggattattcatagctgccctgaatgccgtcatgaaacacctgggcagggcggactgcacggtccactgccgcaatcaaggaccggaatcctgcgccatggatgtggtccggtatattgccgggcgctgcggccgcccaaacattgcgctgataggctaccagcccgccatgctggaacagcttgcaaaggaataccaggtaagggcggttgacttaagccctgccaatatcggccaggaacgcttcggagtcctcattgaggacggacgcatcccagaggtaagccaggacctgtgccgtagagcggacctgattctgtgcacaggaagtacggtctgtaacggttccatcgtgaacttccttccatataaggacaaaatcctgttctacggcaccaccctggccggggcagcccctcttatggacctgcccagactctgctttgccgaccggtatcaggacctgccgtaatcccctgtaacagcctggccaaagcggctccggtactcctggagcaggaacacatttttataaatttgcggtccttcttgcaaaatacatccgcctgatgctatagtatagaaagatttcatcagaacgattacagattgaaggaggactaccatggtatcactgccaaggattggcgaaaccataagcggtttcactgtcactgaacttgggactatacacatgctgggcaccaggaccgttctgtttaaccacgaaacaagcggcgcccagcttttatatattcaaaacgatgaccgggaactgggttttaacctgatttaccggacgccgcagatggatgagctggacaattcccatatactggaacatcttattttgtcatcctgcaaaaagtatcccagcagggatattttctttgatatggacagcaaaagctataccacctttatgaacggccttacggacaatacctttacctgttacccggtgtgcagccagagccaggaacagcttctaaaactgatggatgtattcctgtgctgcatggaggaaccggatgccctgaaggacaggaatttttacctgagggaggccatacggtatgagctctcatctgccggcggtcccctggccatgcagggcacggtgctcagcgaggactggggccatctgaccgatatcctggaaaatgcagacagcgccatgtcccataccctgtatgagggaggacgcactgccaatctgctggggcgggcacaccttcattacagggaactgtcctacgaacaggccagggaaacctttggacgatgctacagctacgccaactgcctgataaccttatatgggaatctggattacagggccgtgttacattttctggacagagaacacctgtctaaagtcctctcaaaaggcagcagccttcttggggaatttggggaaccggtgaaaccgggtttccggacctgtacggcgcagagtcccgcttatcagggcagtccctcggaacacgcctctgtggtggattatggcatcgacctgtccggctgcacaagagaagatctgatatactgggacctttttgcagatattctggataacgacacctctccctggcacaggcatgcaagggaaatgggactcaaccatgtaatggaggtttatctggacattctgcttccccacccctccttaaagttccgcctgcgcaacggggattcctgtttgaaggaagtgtttttggattccataaggaaagcccttgaagatatcagccgggacggcctgtcctccagactgtaccaggcttccatgaaggaaaaccgtctctctgacgcccttacccgcgaggccccccatctgggctttaatctgtctgaagaaatcggacgtttctggagcaccacgggccggactgattatttccagctctatgaggatgccttccggcgctttgaaacagacccggaccagaccatcataaagaagctggctgcttctgcccttcatcccgcagccagcgccctggtggtaaccgtgcctgtacccggtctggctgagcagctggaggaggaaaaggaacagtatctcagggaaaagctggattccatgactgccgctgaacgggaacagctgataaatgagacagacgccttccgcctctggaactccatggaacggagcaacatggattttctcatacagccaaaggaacttcctgagccggcaaacccatgcccgttcaccaaacgtcagcacggaaccatcacatgctacacctctcccgccccctccccgggcgtgggcagttaccagctctattttgacatcagccggattggtaaggaggaccttaactaccttacgctctatcagatgcttctgacggaactggacacaaaacgcttcacggtggaacagcagaaaaacctggaacaggaatatcttcacgactgtacctttgatgaactgtttcccgaacataacgccggtcccttaagccatcccatgatgagcgtattctggtacggactgaccggcgattttgaaaagggactggattttctcctggatgtaatgggcggaggagattacagtgacacggacaccattatacaggtactggaaaaatatctgcctgactatgacctgtccaaggcggacaatgcctctgccctggccttcagcctggccgagggctatatgaggcaggactgcagattccgcaatatgttaaacagccaggaaaattattattttctgaaggatgtgctgagacggctgaaggaagagcctgactttggaaccgcagccgcagccaggcttggcagcattgcccgtaccatattgaaccgtgacggcctggtattcctggcagctgcttcaccggatgtattgggaaatgtggagcaggccgctgtggagatacttggaaggcttccggcttttcaggatagatacagcgcccctgcgccatccatctggctcccggaccaaaaacaaaggctggccgtgtgcgtggaagcctcctgccaggagacgcgcctcataggtgatttttatggaaacacctgctttaaagggcgttatctcccctttctcatggctgcggcggacaaatatttaaaacctgctgtccggtaccagggcggggcttatgacagcggcattgatttctatatccctaccggctatttctccctgtggagcaccgcggaccctgaggtcagaagcacgctggtgctcttcctggcaaccggcgcccggctcatggaactgccgctgacggatgaagaactggacggctatatcctgaacacctatgcccaggcgcttccgccctcaggaaccttgagcacccgtatgcggcacatgcgaagggacatggtgaacatagattcccgcaaaataaatgagatgatttcagacatcaggaacgctgccctcagccaccagcaggaggctgcccgggtcattgacggaatattgcggcgcggggccattgtcaccgtggggaatggaaaatgtatcatgagggataaggatgtgtttgaccaggttctggtttatcatacggatgaggtttaaatggactgaccgggataaaccggccgtgcggacagaaagaaagccccggagtttttccgcctccggggctttccttttatatcatggattccatcttcatccaatcccgccatacacaattcccagtataaacaccaccacggccaggggcacatagacatacctggccagaggtccgaagaatccgcttaaaggctttttccgcccttcctccagttccttcctgatttccttatagcccagaatataatagatggacacagctcccagcacagcgccgaagggaaccacaatgatggtgataaagtccatccatgaccctaccttgggctctgactccaggaaaatgcccaccagcagggctatgccgctgcacagggccacggctgcttttctggaaagcttaaaccgggtctgccatgactcgctgaccgcctcaaacatattaatcaggctggtaatgcctgcaaaggccacggacagaaaaaatataactgcaaagagccttcccatgggcatctgccggaatatgcccggcagggtaatgaacataagaggcggaccagcgttgggctcaatgccgaatgcaaacacagccggcataatggccagagcagccatcatggcagccaccgtatcaaaaaacgcggtccggatggatgcctttggtatatcctccgacttggccagataggttccgtaaacaatcattcctgaacctgtgatggacagtgaaaaaaatgcctgtcccatggccataacccaggtatccacctttaacaaatcgctccagtccggagcaaagaggaatttatatccttctgccgcccccggcagaaaagctacccgcacagccagtatggcgaacaatacaaagaaggagggcatcaggaccttattgattttctcgattcccttggtagccccaaacataaggatgccggcagctgtcacaaccaccagcacatgccagggaatactgccgaactcgcctgtggcctggttgaaatagaccgctgcatctgttgtgaggatagcccctgtgacggaaccggccaatgctcttaccacccatcctacgatgatggcatatccgatggcaatacccagggaacccagcagaggaatccatgccaggaaatatcccagcttacctctgcctatcttttcccagcagtattcataagctcccagggtgccggtcctggcccggcgccctatggcaaactctgccgaaagccctaccaggccgaataatacaatgaataaaatatagggcaccagaaacgcgccgccgccgtattgtcccacacggtacgggaacatccagatattgcccattcccactgcggaacccacacaggccagcacaaatcccaggctgcttccaaagccgccgttctggtgcacggctgccggtgaggaatccgtttttttctgcttgctcataacttctcctttatggtgtatgtttcaacggcctgcacgtcctgtgaggaaggaaaacaggacagtccaaaagccatctttactatactaccccaataacaccatttagtcaaagctttaaagcaaaaaagtgacaattgttaaaacccatcaaccacatcataactgcttccgttccacaaagccggccgcacctgcctggttttaagctgctccacaaaatcgttcagccggtccaccttctccggcagccaggtaacatactttccaatctggcccgtggtgtgggcatcgctggctccgatagccttaagccctaactcccggcagtatgaaagagctgttcggttggcttccagggtcgtgctgccgttgagcacctccaccccgtgaagccctgtgaccgcgcggagattctcctccagcccccggttattgttcctgaagggatggcaggagacacagaaaccgccggatttattgacatggtcaatgaaatcctgggcatccacccggcggtccggatactgttcaattccccatgccgtgatatcgccctggagggaaaagaattctatacccacgaaaatgggaaaaccggttctgtccgaatattctgcggcatattccctgagccccatgctgtcatggtccgtgatgcagacagcgtccagtcccctgccccgggctatggtcacgatttcctccagactgattcggctgtccgatgaataagtacactcatgaagatgcatgtcaaccagcattttgatttctcctatctcttgatgattttaagcagcctgccgtcctctgtccataccaggctttccaggtccatgaattcagctacaaaggcgctggctggacggcggcaaaggtccaggggcgcatcattctggaccagctgtccctggtccatgattgcaatgcggtccgccaggataatggcctcctcctggtcgtgggtaacaaacaccatggtcagtcccaggtccttctgaagccgtttaagttcatggcgcattttggtgcgcagggccgcatccaggttgcagaagggttcgtccaaaaggcacagcttcggctccacaatcagcgccctggcaagcgccaccctctgctgctgtcctccgctgatttcctgtatataggctgaggcataatctgaaagacctaccatttcaagataatgcattcccttctgccgggcctgttcccgctttactccccggaatttcaggccgtaaaccacattctggagcactgtcatgtggggaaacaggccgtaggactggaatacggttgtaaccggccgctgttccggagggatatgggtgatatcctcgccatccagccgcacggctccgctgtccggcgtcaggaaaccgcctatcatgttaagggtcgtggtcttcccgcatccggaggcaccaaggatgcagagcagctggccctgttccagggtaagggacaggtcccgcaccacttccctgccgtcaaagtgttttttcaaatggtccagttcaagatacacgtcgcttacctgccttccatgttataaaataagccagcccttccactgccagcactaccagtatgatgctggtggcaatcagggaggccagggcgtaatcccctgtgtataccgcatcaaagagtttgaacactgccagcttccgtccagggtcaatgaggaacaggattgctccggccgtggtcatgctgctggaaaagttatagacaaaacagctgagaaaggctggtctcagtccgggaagtattacggttttcagcactgagaactgtcctccccccaggtcccgcactgctttttcctgagcccttggcacctgggtcagggtagccgcgcaaatctttgtggctgtgggaagctgtttgaacagcatattggaaataacaatcagggctgtaccggtcagctttaagggcggtgaatgaaatgccaggatataaccgattccaaagcaggttcccggcagcatatagggcagggtgaccagacaatcaaaaaaattcctgcccggaatccgcctgcgttccatgtaataggcgaacagcatggcgaaaagggtacctgccagggatacaatcaaagcatatgtcacgctccgccccatggtccccaggtcaaaacggaccagctgttccagataccgggcggtaaaggagtacacccccctggtgcttttcaggaagcctgatataaatatgcatccgtactgcagcgccatcatcagaaaaaagaccaggcttcccaggttggccagatttcctgtcaatccgcattttcccagtgaaagggccaggggttcctgcctccccctgctgccctctgtcagcatatccgaacgcttcatcagcttacggtaaataaaaaatgcagcgatagacggaagcatcaggaccatgttcatggcagacgccttctccaggttggagtatcccaccagctgaagatatatctccgaagcaatggtgctgaaccgcccgccgataatgaccggagtcccaaaatccgccagggagcggacaaaggagagaagcagggccacccatatacccggccgtataagcggcagcacaatgtctcccaaaatggctttagggctggcccccaggtccctggcggcccggatgctgtccccgtccagcttggtcagaattccccccaggaacagggcgtttaacggtacaaaggaaaggctctgcatcaggatgacgccccagcagttataggggtcccagcccagccccagcagccggtacgtaatccacccacggcgtccatagagctggatataggccagggaggatacaaagggcggggaaaccatggtaatcagcagaagcgccatacagaacagcctgacagctccccttctggtagctaaaaacagggctgccgccgtggaaaaagcagtacagagaagggatgcgcatacgcccacgaacacgctgttccaaaggtttcccctgtattggttccagacagcggcatatgcatcatagcttaaggatttcccgtcccacagacttctaatcagaatacagagcatgggccagaatacgaacaggaatacaccggacagcaggaaagccagcagcagcttatccgccccgtatcctgcaatgccaaaaaggacatctttcgatgcccttttgccatacatgtctccatgtatattcctgtttgtatttccattcatgctttcatgagtgtttccaaacttattcatctgctgccttatctcccatcagcgcctcaaagtgctccaggatttccgtacgcttttcaccgaacagggacaggtcctccttcatcagcatacctgtgtcatatcccaggtccagtccttccagggatggcttaatggtcttcacgctgttcttctggtcaatctccgccagcatctgaagattctcatcgctgctgaacagccactctataaaatacctggctgcgtctgcattctcggcattcttaaatgcagccactccctcgggaacccacggaatgccatctgccgggtaaacgatggacacatcatactcatctaacagggactcaatggtgccgtcaatatatgtgatgccaatggcatattcatctgtggtcaccttattcttggggtcggaaccgcgttttgcataatatgcaatgttcttattcagtccttccaaataagaccagccgccttcttctcccttagcctgcagcagggcgttgaccactgcatagttggtacctgatacagccgggttggacatgatgatttcgcctgcatattcttccttcaataaatcatcccagctggcaggagcctccagattcagctcctccatgaggccgtcattgagcagaaaacctacaatggtaattcccttggaataccaatagccttctgaatccttgaactcatccgccaggccggctgatgcgtcaaaggtaacctgctctaacagcccgtcatcctttgcgctcatgaacgcgtcaataccgcctccaaaccataaatcggcggatggtgttccgccctctgcgcggagcttggaaagcacctcgccggaagacatggacagcagttctaccttaacacctgtatcctccgtgaacttgtcaaacagggttacgtaattctcactggtgacaaccaccttcatggtaccggtaagagccggagcctctgcctttgtctcctcctggctttcagtctctgtctctgtggctgtttcctcagtctgggcctcggcagaagctgctgcgctggtattattgctggtattattgctgccgcaggctgccagggccggtaccatggacaatgccgttagcagggcaatcattttctttctcatctgtgttcgtatcctttctctcataaccgtattttgcatcacagtcctttatcctcctcttaaggacagtaattaccattgttgaattataataagcagctgtctctaagtcaatatgaatactgtttgcatagaaaaaaacgaacagatgagaaatcagatagaaaaaatctattcaagggttccggctgccagtctccgcccaaatcattcccggcatcattttacaaaaaggaatggacggtgccagggcattgtgatagaataaacgaggttattttcccggcatatggccgggatttttaatggatataacggagggattttgagaatggaacataaaaggagtcaatgggccagcaacataggatttatactggctgccgcgggaagcgctgtgggactggggaatatatggaaattcccgggaaaggtggccgcaggaggaggcggggcgtttttaatctgctatgccctgattgttctgctggtaggatttccggtcatgctggcagagctctccatcggacgcagcacccagaaaaacgtagtgggcgcgttccgccggctgaacccgcgctggagctttgccgggggcatcggcgtcctgaccctgtttgtaattatgtcctactacagtgtggtgggaggatgggtgatgaaatacattgcagtgtatctgaccggagctgatttcagcgcctttggaaatgacagcagcagattttccgcctactttgcggatttcatatcccggccgggagagcccctcatatggggcgctgccttcctgcttctgtgcatctacgtggttgtacggggcgtgtcagaaggaattgaacgggtcagcaaatttttaatgcccggcctgttcgtactgctgaccggaatcgtcatctatgcaatgaccctggacggggctgctgaaggtcttaagtatatgctggccgtggacccggcaaaattcaacggcggaaccgttgtggctgccctgggccaggcattcttttccctcagcgtgggaatgggcattatggtgacttacggctcctatgtgcccaggacagaaaacctgtccaaaagcgcgggctgcatctgcattctggacagccttgtggcactgctgtccggattagccatcgtaccggtggtctatatcacggccggacccgaagccatgggaatgggaggcggctttgccttcatggctcttccggaggtattcagccggctgcccggcggcgtgttctttggctttgccttcttcctgctgctgtttgtggctgccctgaccagcgccatcagcatccttgagagctgcatcgcatggcttacggaggaatttggactgtccaggctgaaagccaccctgcttcttgtgattcccatgtcatttttaagcgcaggctattcactgtcgcagggggccatggacataaacctgccctggtttgatttcaccaacggcgtacagtatcttcccatgaatgctgtcatggaaaaattcactgacaatctgatgattcccctgggagccctgtgcttctgcctgtttgtgggatgggtatggggaacggacaatgcctctggggaaattgaagcctcgggccacagcctggcctggaaacggctgtgggcctttctggtgaaattcctggctccggcggttattgtggtcatcttatattttacggttggacgcgggcagggcctgtcctaaagggccggccccgcatatcatgaatcaatggttccggcatctgtttttccgaaacctgtatttttttcttcccggtcttcgtcagcacggtctgtcccggcctgcagattatccgcctcccggttttcctccagcgcatccatgctctccttaagactctttccctggctgtctccaagctccgcagcctggtcccgcagagacgcaatctccatttcctttctctttatggcgctggtctcattgtcaatcatatccgccacattggcgccccccatgcccttactgaccagggcatccacatggacgccgctctggctggcttccgcttccttcacatgcatctcaccttcaatccggtcctttacggatgctatcctctcagcatttctgatgccgtccgatacattggcaaggctgcttaaacgctctgcttcccgctggtcctccgtcttattggggtcaggctttccggacttttttttgtcatcctgttccacacacgccttggcctgctgggcatacagtccggctatctgtttgtccaggtccgccagctgcttcccgtaatttttcagctggtccttgatatcatccaccttgccgccgtttttcaaggtactttctaccaggtcattctttctgtcaataatggcctgcttctgctttgtcagattctctatcatactcataaactttccctgaggcgagaacgtggccctgtcactgcgccctgttccggctgcttttctggttccggccttattttttgcaaaggaggcgtttacccttgccgcattgatgatggtgtttttaggctgaactgaattaaaattaattctcatagtctttcctcccgctgggattttttgttcctgtctatgttatcgtacggttgctgttaaagtttacagtgccggaatataaataaaatggaggcctctgtcagaacatactttatcaaataaaaaaaggaaggctgtcaacctgcatctgctgacatccttcctcttactaattcctctgtatgcctatatcctgtccacactcactttaacaaccacttttcttaccttccccggatgctctaccatacagccgggccggtggatatcactgggaaaaaatatattataacagcctttggttgcaatcaggaaactctcgtcacctacagcttcatagaagtaaatatcactctcatcttttccttctgtaatagccaggtctccaaggtccggcgcaaagcccagcatctccctcccctttgccacaaactgaacatccacatatttcttatgtatttcaggttttttatcattggaaggacaggttgttatatccatcaccattgcatagatgtcctttccgtctattgcatatgtccctggctccatctgtgtaaaatccctgcccataagatattccaatgccttttggattccctctggatattttcccaaatcctcattggtataaatagatgaagatatcatacagccacctctttctacactgtctcaaaatgctgttttaacggcacataaacatcttttctcaaaccggataaaagcatcttaaaatttgtgacatcgtttctcagcgtcatgacccgtacaccgttctccgccatttcaattgctctctccaggttaggaggcgcgatgggacccattaagggaatgcttttttccttggcctttttaaataagagttcaaaacggctttttacctggggattatcaaaattatatgtctctttaattcctaatccaagagctaaatcagatggccctaactgtaccccgcccaaaccttccacattcagtatctcatcaatattatcaaaaaattccgggtcctctgccaacggtattaccagtgtttcatggttgcatttctcaacatattgtccaaaatcaaaatccggatagcagccataacccgcgcttctgcaatctgtggctgaccctctcaccccataaggaggaaacctcacagcctgtatcatctttttagcgtcctcagcagtgcggcaatgaggcaccactactgcgtctgctccgaattccgctgttgtacgtatcagcacctcatcgttatatttaacacggacacacgtccccattccgctctcatttgcggcaattatcaaagcctgaagctctctgtcaatggtcaccggtgtatgttccatgtcaatgaacacaaagtcgaatccagaatatcctatcatctgaaccacaatagggcttcctgtaaatattcccatacccactgccagcttaccctcatccagtattttcttaattttgttctctctcatacttattctccttattttatttgtgcttatattacacatttctctattctcagtacaccgttttagtatttcagaaatattttcggaagaatcaaaaccacatcgggaatgtatgtaatgacaagcaaaaatgcaatcataaccccaatcatgggaagtatctcctttataatgtccttgagcggtgtatcagagatggccgatgtaacaaacagcaacgggccataaggcggggtcaccatccctatcatcatattaattacaaacatgacgccaaaatgcaccgaatctataccaaaactttgaaccagcggataaatcatagggataaataccagtgttattgtgttattgtcaaatatcatgcccagtatcaggaacataatattgcatatcaacaggaaaacatacctgttatctgtaattcccataatgaatccgcctaacaaggtggggatgcgttccagtgtggatatataaacaataacggacgcacagcccacagttatggaaacagtgcccacggttcttgctgtttctaacaatattttttttaaagattcccagttcagcatcctatataccagtacggaaacaatcaacgcatacgctcctgccactgctcctgcctccgtaggtgttaccgcccctccatagataccacctaacagaataaccggagtcagaagtgcgggaattgccttaaaggtataggtcaggaacaaaggaatggtatattttgttccataaggatactttcttttgtaagacactatcagacagtacgctcccagaaatactgcaagcattacacctggcagcatccctcccataaacagtgctcctacagatgcccctgtaagggacgagtacagcagcatggtcatgctgggcggaaagatagggccgattgtggccgaggctgccgtaatagcacagctgaatccatcatcatatccctgacgtttcatctccgcaatttccataatgccgacgccggaggcatctgccatggccgaccctgtcatacccgagaatatcagggataccaatacatttacctgggccatgccgccgcgcatccttcccacaatgccatctgaaaagcggaatatcatatctgatatcttgcctgtattcatcacattagctgtgaatacaaacaagggaattgctatgatgacataattgttccaatacgcctcgcatatgcagttcggtattactccaagattcccacctgtagccagcatatagattacaccaacagagagcatccccaatgcaatgggcatccctgtaagaaaaatcatggcaaatgctgctaaaaatacaacaattccaatattcataccatgttccctcctctcctaccttttttgtctcttcatgagccatttcctcacatccctatacacatccgcaaaggaataacacattacgccaaaagtcaggataatgattggaaaaaagtaaaacttcacaggtattttcaaggatgggcttactgttctgtacttcatgatataccgaaccgtaggctttaacaggattgcatatgtgatacccattactaaattgcggaaaatccttaaccccctctgaccgtcttctgaaagcaaatcatataccatggtaaaattaacatgtttgtttaatctacggacataacacgctcctaaaagtacggtccagatataggttgccacctgtacctcagtcccccatgcgggaggacgattcaatacatatctggaaaatacagaatatacaaatgccaggaaaaggactgagaatgtaatgaccggaataaggacttccacacaatccctcattctgagaaataaccatttaattttttctctcattgcatgcctcctttcattccggcgcttacttagttattgcattaaaaatatccatattccaatttttttcattgtccggattggacagatagtactcaaacgcatattttttgaaggcatctctatccggctcctgtatgttaattccatacttctgcacacattcatccaggattttttcttcctccgccagtacatcctgattgttcttattaacagcctcttttataatttgtgtcagcttttcctgctggtccggtgtcatagcctcccatttatcgccatttatgcataccaggttggctgttatcatatggtctgtcatgattatgctttttgatacttcctgcatggcattggcataggaagacagtattatattctcttgagcatctactgtacctgtctgcatggcaaggtatgtctcactgctgtctaaaggtgttggctccgcaccgatggctgtccccatgtcaagaaaggatgctgagtttggcatacggatttttaccccttttaaatcttctggtttctgcacggtaatggaaccgtctgaaagccacacatcacgccttcccagataaaacggggcaattacctttacatggaattcctcccaaatctgattctgaacccattttccaatctctccgtccgtgtctaatacctgcatcatgccttccacatcatcgtataaaaatgcaatatcaaacatgtttgcccacagagccccgttgtcatagaaatatcccaactgaataaatccaatgtcaatatttccatccaaaagagcccccaactctgcactggatttaaaaagagtggcactgtcatagtgctcaaactgaaagtttccttctccttctttatctgatacctctgaaatcctggattgcaaaagctgggttgacgcccccggcagctgggaagtggatgtaatcaattttacggtgttctttccgccagtatccgcagctgccgccttttctgtctgtgtcccggatgtttgtgcaccgacttcctgatttcctgtttcccctttatttttcccggaactgcagccagccaggaaaattgccataagtactgccattgccagaacagctgccccttttttattcatcatatagtaacccttcccctttcagattttatgaattcatttttatcatttccacatgctttcttgcccggttttctatctcctgataatctttattctcaatcaggtcatttgtcagaaatgctcttgttccaaatgcctttattccagcctgtagaaactgcggaatagtatcaagactcacattacaggtggcctgcatgggtatatgcccaaggggacccataagatatttcacatcattcacatcatccacaatatacagttttacaatatctgcgccgcagtccctggcatacacaatttcagtgggtgtcatagcccctggtatggacaccatatctaactcctttgtgcgttttatcacagcctcatttgtattgggtgaaacaatatacccggcccccagtcgatgggccagctccacctgacccactgtcaatactgttccggctcccatgcagaccctgtctcccacagccgcttttacagccagcatctgctcttcaaaatacttctcaggactatccttccgatggttataagtaatctcaataaacttcactcccccatctgccagagccttagctacattagctgcaccctcagtaggaatcccccggaaaatcacaattaacttttccttttcaatactttttagtacatcttttccattcatgtccacatcctcctacgcttttcatattgtcaaaaatatacaatgttttcacttttatttatgcacttttctatcctcccctcctgtatgcggagggggttttcttatgttttgacacattgtatatttttgttatttatagtatactttagtatgagcataattactaattcatttttcaggattcaactatcgaaaaaaacgatagcattcagagaggtattgtacatgaatacacggcaattagaatatattttagccattgcagaagaaaaaaatattctccgggcctcagaaaaactttttatatcgcagtctaccctaagtcagacgctgcttaatctggaaaaagaattgggaaccccactttttatacgcaatccgagggagttatccatcacggaagccggccagtattatatagacgcctgcaaggatatcatgcatataaaagaacagacatacgaacgaatacgcaatatttccaatatgggtaaagaacgttaccgtgtcggcatatcctcccaggaggggatggagcgctttttgactgcatctggtatttttcagaaaaaatatcctaacgttgaactgtatgctaccgatgaaagcgctaaaaatttattaaaaaaactaaatatggggcagcttgctttaattattacatccctggattctctgcaaaaaatcacgtttccttacaaagtactcagccgcgaagaaattcttttactagttcccaaatctcttccttataaatcaggaggagaaaaccacaaattaaaatgggaattgttaaaaagtgaacactttattctatcaaagcaaaactctaccatgcgcagtattacagaccacatatttaagcagctaggcgtgaacccggatatcgtatgcgaactggacaacacctcagcaactatacacatggtagctgaaggtattggtctggccttcctgccgaagggtcttaaggttgaaaatgaacacatccgttatgtatcattgatgcctaaagtataccggtatcaggtagtaatctatcaggaagaattggctctgaatcacaagatgactgattttattgacatgctgtaaagggtgtgcgccagcccttcattaccgcatttcccgtttcgcagtttcaacaaattccgcgttattattttaacttttattgactattttgcctatatttgttaggttagtctttatggatacatatcatttcagaaatcagacataaggagaataaagcatggaaatcaccagccaactgaccgccgaggaaaagagggctatcatccgggacaacggaggggacaaagaacaccttctggctatcctctatgaactgcagaacgcctcaggctacaactacattgatgaggaaaccgccgcactggtggcagaggaagtgggtatgaatcccacacgggtatatgacatcataacattttacgccatgttaaagacagaaccaaaggccaggtttgtgctgaaggtatgcaacagcaccccatgccatttctcccgctccgaagaaatcgcacagattctcaaggaggaactgggggtgggcataggcgagaccacagaggacggactctttgcctaccactatatcccctgtgtgggggcctgcgacataggacctgttatcaaggtaaaggacacggtctacggaaatctggaccgtgaaaaaatccggcggcttctggatgacctgaggtccggaaaacgcaatcaataattgagggagaacacttacatggaaataaatgaatccgttttattaaggcgcgtgggcagaatgaaccctgtatctgttcctgagtttgaagctctgggaggattttcaggcatacgcaaggctctggccatggaaaaagaagaaatcctggaggaaatcagccgttccaatttaaagggacgcggcggcgcaggctatcctgcgggccggaaatggaaaagtttatacaggattgagggcgatacaaagtacattgtatgcaatgcagacgagggagagccgggcaccttcaaggacagggtgctgttggaggaaacgcccctaagcgtcatagagggaatgctcattgcaggatatgtgttcggctccaaacaaggttatatttacatacgcggagagtaccggagaatacagaagatttttgaggaagccatacggaatgccgtggatgccgggtatctgggaaaggacatcatgggggttccgggctttgactacagcatcaccgttgtctcagggggcggcgcatatgtgtgcggcgagaattccgccatgctcaactccattgaagggaaaatagggcgccccagaatcaaaccgcctcatctggccgaagtaggtctgtacggcaaacccaccctggtcaacaacgtggagactctgtgctgcgtccccgtcatccttgatgagggcagtcagaagttcctctcctacggcacgcctgaaagcggcggaaccaagctggtatccataagcggccatgcaaaaaacaggggcgtgtttgaggtgggtcttggtatttccctgggcagcctgattatggaccaggagtacggcggcggcacgtcaaccggcagaaagcccggtttcttccacatgggcggccagtccggccccattggattccccgaacagctggatacgccctatacctatgaggacctggcccgggaggggctggccgtcggttccggcgccattgtggttctggacgacagtgtctgtattgtggaatatatacaaaaggtctttgaattctttgtccatgaatcctgcggaaagtgtactccctgccgtctggggaccacccgcatactggaactgcttacggatttcgtggaaggaagggccagggaaggggatgtggagcgcctggaatacatggccaatcaggtgtcccagctttcggcctgcggtctgggccagtctgtaaatgtagccctgatgtccgccctccgccaccgcagaggcgattttgaagcgcatataaacggaggcgcctgccctgcgggagcctgcgtatgtcatgagaacgggaggaatgaaaaatgtctcaccatgtaaatccggataccaggatacatatagaaatcgaccatataccatgccaggtcccgcctgagaccaccattcttacagccgcggccggactgggcatccagattcccaccctgtgctacatgaaggaactggctcctgacggttcctgccgcatgtgtgtggtggaagtggacggaggacggaaaaagggccttgtcactgcatgctccgagcactgcaccgagggcatggttatttccacccgttcagataaagtaattgaagccaggcgctttgtcctggacctccttatgagcaaccacaaggagcactgcttctcctgtccgcagaacggttcctgcaagcttcaggactactgcatggagtacggcgtggaatacaccagctatgacaggggaaaacgcgtaaatgccccaaaggatacatccagtcccttttttgaatacaatccgcagctgtgcatcatgtgccgccggtgcgtacggatatgcgaggagcttcagtgcaggaacgtaatcagcctgaaggaccgcagctttgataccatcatcaccactgcctacggaaagccctggtctgaaaccacctgcgaatcctgcggcaactgcgtctcccattgtcccacaggggccctgtcagccaaggaccataagaagtaccgcagctgggaggtcaggaaggtcaggaccacctgcccccactgcgccaccggatgccagatggacctgcttgtcagggacaaccggattgtgggagcagaaccggccgacgggccttccaaccacaatctgctgtgcgtaaagggcaaattcggctcatacaagttcgttggctccggcgaccgtctgacccatcccctcatccgcaggaacggacagctggagcaggcttcctgggacgaggccctggattacatggcaaaacggttcagggagattcagaacaaatacggcaatgacgccatcgctggtttctcctgttcacgggctcccaatgaggacaatttcgtgttccagaaaatgatgcgtgctgctttccgaaccaacaacgtggataactgcgcccgtatctgccactcagcgtctgtgaccggtctggccatgacccttggctccggcgccatgaccaatcccattgcagatattacaggggatgtggatgtgattctccttgtgggctccaaccccaccgaggcccatcccgtggtgggcacccagatacgccgcgccgtcaggcgggggacaaagctgattgtggtggaccccaggaagattgacctgacaaacgacgcagccctgcacctgcagattaagccgggcaccaatgtggcctttgccaacggcatgatgcacattattctgaaagagggcctggctgacatggatttcatttcatcccgcacagagggatttgaaatcctggaacagattttagaagattatccccctgagagagtggccgaaatctgccacatccgtcaggaggacctgatacaggctgcacggatgtatgctggcgccggaaaggctcccattatatactgcctgggcgtgacagagcactccacgggcacggagggcgtcatgagcctttccaacctggctatgatgacaggcaagctgggaaggcccggatgcggcatcaatcccctgcggggccagaacaatgtacagggcgcctgcgacatgggatgtctgccaacggacttcccaggctaccagaaggtggcgaatccggacgttatccacaagttccagatggcctggagcgtggacttaaatccaaggcccggccttacctccaccgaggtctttcctgctgccattgacggaagagtaaagggactgtatatcttcggggaggacccggtcgtaacagacccggatacaggacatattgaaaaggcgctgaagagcctggatttcctggtggtgcaggagcttttcatgacagagacagctgcctacgcggacgtgattcttccgggcgtcagctatgctgaaaaggaaggcacctttaccaacacggagcgccgcctccagcgggtccggaaagcggttgaacctgcggggcaggcaagggatgacatacagatattctgcgacgtcatgggacggatgggatatccctgccattatgacggcgcagcccaggtcatggacgagattgcgtacgtaaccccgtcctacggcggaatcagccacgccaggctggatgcaggcgaaagccttcagtggccctgcccatctaaggaccatccgggcactcccattcttcatacaggcagattctccaggggccttggatatttctatcccgctgtgtacaaggaatccagggagcttccggatgaggagtatccaatcctcctgaccactggacgtatgctctaccactacaacacccgggccatgactaagcggaccgagggactgaatgaaatctgcaacgaatcctatatcgaggtcaatgaggaggacgcggcttcccttggcatccgtaacggagacaaggtgcttgtatcctccagaagaggacagatttccagcaccgccagggtggggcagaaggtacacccaaaggaggcattcatgaccttccactttgcggacggcaatgtgaaccgcattaccaatgccgcactggacgacctggcccggattcctgaatataaagcatgcgccatccgtatcaggaaggcgtaatgaggtgctgataatggaattcaccaaacagtatccaatcatacggtatgaggacggcagggaggagccctccgcagatgaagtactggcggaatgcgccctcagcgtgcgcatcaacggccgcttagcggaagtccttcactgtattccggaatacctggaggagatgctcttaggcaggctgtatacctcaggcgccatctcctcccctgaggatataacggatttaaacattcatccgtctctctgccgggcagacataaaaatccgggaaacggaccgtaccatggtccgcctcccggattcacacatctgtcccaatgacatactcatgctttcccagcgccttctggacgcctcggagctgttccgcaaaaccggcaacgtccacagcgtaatgctgtgccgtgattccgaggttctgtacctgacagaggacctggaccgcggccgggcatttgaaaagacagttggccgggccttaaaagaccatgtggactttgctggcaccagcgtgtataccaccgggcggattcccctccccattgcgcagaaggccatatgggccggcatacccgtcattgtatcccgctccgccccaacggacctgaccctggagctggccgctgcctacaacctgacggtcatcggatttgcccgcagaaacaggatgaatatctaccgtgcagcccgtaatggctcctctgccccatccccggtcaggccagatatgtaatcacaggaatggtaagcacagacaggatggaggtcagcgcaatgcttttggctgaaatccttccatccgtggccccgtattccttctcaaccagcatgaccacgctgcccaccggcattgcaatcaaaaggataaagattccgtaggaaaccttgtcaatgggcagcatcctcagaaacgggatgcagacagcaggtatgaccaacaggctgataaaggcaaagagcagctgcttcctgtcggtgaccagggactttaagtctgactgggccaccatgattcccacggtcatcatggacaggggcacggctgcatttcccatgctgtccacaaaaacagccgcgggttccggcacccggatatggaatgcaaatataagaattgccaggatacaggcgcccatgccgatatttagcatcttcttccaggggagcccggtccggtccgtcctgctgttttgcgccccgtcttttcttttctgtccgtttccagcctttccttgcggcctgtctcctctatttttactgtcatcccttgtccccatagccagaagaataccatacgaataaaccagaagattataaccaacaatataaaaggccacgaatatcacagcctcttccccatacaggctgcgcaccagcgggattcccataaatcccaggttggggaatatcatcataaggcggtagctgtttacctccccgggttcaagtcccataagctttgtaaacagccggctcaggagaatgagaaccaggaaaaacacagccaccaaaaccaggttctctgccaccatgtgaggactgtatgtgattttcttattcagtacgccggatataatcagacatggattaaagatattgatgataacggaagacagactcctagagccttcctgggagacgatgtgcgccttgaaggcaataaaaccagccaacatcataaaaaacaaaaccagcatctgcccggcaataattcctgcgttcatttctattacctgcttttttcttgattgttccattgtagctgattccattgctattttcaatgataactccagaaaacaaccgctgtttataatgactgttcccctgtctgccccataaattaggttgagccggcaggaaaggccctctgccaatcccaccggcttattatgtatggtatctatatgaaaagctctgactgcttgtttatgtctcatagtataccggctatttgtgtcataagtttgaccgattgctaaatagtttctaaagaggcttaagaaaatataacagaatcttttgattttcttgtgttgacatataatactatatgctgtatagtataactatattatacattgtataatatgacgcgactaataatattgttttcagaacagaggtgtgcttatgatatttaacactggctccgcacttttagacgccattgtactggcagttgtctcaaaggatgcggaagggacttatggatataaaatcacccaggatgtccggctggccattgatatctcggaatccaccttatatccggtgctgagacgccttcagaaggaggattgtctggaggtgtacgacatggccattgacggcaggaaccgcagatattacaggctaacggaaaaaggcagggtacagctgaatttgtaccggggggaatgggcaacttattcacagaagatatcccagatatttaaggaggcgaagctatgaccagggatgagtttatgagggagcttgcatatcttctgcaggacatccaggatgaagacaaggacgatgcggtccaatactataccgattattttgacgaggccggtcctgataaggaagcagaggtcatacaggaattaggaagccctgagcggattgccgccatcattcggaccgacatagcaggacacctggaggacggcggcgaatttacggaacagggctatcaggacgagcggttccgggacccgggctatgccatggcaaagcgtctggacctgccacaggagcaggagggcggcagccagggaaacggtcaggcggatggccaggatgacttcagacagagccagggatttaaccagggatcggaggaccgttatacagatgccggaaaacgggcctcccagacgtctccgcccagaaccagcaaggtgataaagctcatattatgggcagtcctcatcatagtggcattccccgtgttcctgggggtgggcggcggcctgctgggcctggctgcgggagtcctgggcattctgacagctatactggtggggctgggagtcaccacctttgcggtactcatggggggaatcgttatgcttccatatggcgtgttccacatgttttcccaccccctggacggactcatgacatccggtacaggactaatccttctgggcgccggggccctgtgcctggccctttccgtattgttctacggaaggtttgtcccttttgtcatacgaagtatcgtcaatgggcttagccgcctgctccaccgaaggaggtaatgaaaatgaagagattcataaaaatatgcgctgtcaccggactgatactcctgttccttggattgggcatcaccgctgtctcagctgctatgggaggacgattcacaagcaccctgccgtcccggatggcctccagggtctggcacaatcatatgccatggacgctccgctgggacaatgaccgtatggatgactgggatggcctgtataactgggataattgggatgactggggtgacgcggataaccgggaagatacggatgtcacagaccgggaccatgactcttcacaaatgaccacggtatccgacccctcctttaaacaggccaggaaactggatttggatgtagataagggcgtaatacgcattgctgaaaaggagggcatttcccaaatccaggtcaatgtacaggatatctatggccgcacacggtgctacatggacgaatccaccttaaaaatcaagagggagtccgggcgcagccgcggcaacgatgctccccggattgaggttctgattccggccggaaaagaacttgataaactgtccctggatatgggggcagcggaatgcagggtcctgggcgtcaccctctccaaactggagattgacactggcgtgggagccgttacattttcgggcactgtcaatggggatgtggaaattgagacaggagtgggagatgtgaccctgaacctgaccggctcccagaccggctataattatcaggtggaatgcggcgtgggaaccattgacgtgggtgaggaacactacaccatgctttcccatgagacacacataaacaacaaggctccctacaccatggaactggaatgcggcgtgggaaccattgatgtaaattttgaccagaccctatagggcctgcctgcagaaaaggagataacattatggataagaaattataccgttccaatataaacaaaatgctctgcggcgtatgcggaggcataggagagtactttaacattgaccctaccatcgtccgcctgatatgggccatatttgcctgctccggcccgggaatcatagcttatttcgtggcggccatcatcattcccctggagcccaactaaggccgggacaacaccggccccggcctaatcatcagccttctccggaagctgcagccatacagacgcataaaacatgccgtctttttgttcaaacagggcctcgcctttataccggtccgctatttcccgaatcgaggcagcgccgattcccacccctttccgttttgaggaaaggggtgttttgctgtcagcgtcaaaggccacggtccttgtacaggtattgtctgtgaggaatacaaggctgtttttatttttcctgctgatgcgcaggcggatggagcattttgcatccttctcccgaaggcaggcctccactgcattttccagcagattgcccaggataaccgtcacctcggtatccgatacagggcagggttccgggtagtctgcctgggcttcaaagcgtattttatgcctgcgggccagggaagcatagtagcagaccagggcattgaccacctggttgcggcaatagatttcctggatatccggcggcagctctgtcttgtaaatctcaatgtactcagccaggccggacctgtcatcccggtctatataggactgcaccacagccagatgctgacgcaggtcatggcgcgcctttttcatgtcctccatgtgggccgacatggtttcatactgctttttctgggccaggaggcttcggtccgcatactttaactcctcctccagctgggtctttctgcgggatatctccaacaccttcaaaaaaacataagacacatagcaggtgccaagcagcatcagatacctggaaatcagaaactgccaggaagcatatgcatatacatcctgcaccgtacagtaaagcatgccgaacagggtggaaaacaaagggattttccacatataccgccacattctccggtcgtccatcttcagtgcctcttttaccgtatgttccaggaaatgaagtatgaaaggataagtgaggagcagcagtaccaccctggctatattatatatgagataagggtggacctctgaaaaatcccaaaaaaagcggctctcaataaaattggcattgccaaacacaaaaaaggaccaggccatcaggagcaggtaggtaaacatcagtttctggaactgttccctgattaataaaaatgaacacgtcagattaaacagcatgaagctgtaccgcatcagggtagtccaacgggcggcagcctcatagccgccctgattgataaggcagaaggctgcgctgttcacacacgaaacagccgccatcatcagtaccacatacctgtaccggattttcagcttgtccctgtggacccagtatctgggaaggccaaagggcatgaaatccaaaaagggaaacagcagcgtcatagctgtatccatcatagtaaatcctcctcccttgcccgccggaacatgtactgtgaaaaccggctcctgatttccttatggtcccgcttgcgaaacggaacccgttggccggtatccatgaggaactccatctcctccatacgcccaacacggtccatgttaatgataagccccctgtaacaaggcaaaaactgaggataagcagacaatactgtctccagagacgcaaagggtacccggtatctcaggataccctgcctccctgtatgtacctgcacataatggccgtcccggtcacaccagagaatatcctttaacagtatcctgtcatcccccagggcaatgaaacgggcatttaatatcttttccacccgcgccagcctcatggtcctctcaaatgcttcatatgtaaagggttttataagataaccgcaggccctgaccccatagctgtccactgcatggtcatggctggtggtaacaaaaatcagggcagccgcctcatcccgtttccttatctccctggcagtgtccataccggacatgccatccatgtactggtcaatgaaaatcaaatcatatacctggggccggaaagcgccaacaaacccggtcccgctttcaaactcatccagttccggtacttccccttcataattctcacggatatagcgcatcagatattcttttatctcctgcctgcacatcactaaatcatcgataatggcaacccgcataaaattccccctttgataggcaagaaataccttcctgacttcattttacataaaacagacacttatggcaaatgcaaaatcaggccaaaagctgcaaaatcaggccagcttattgaatgtacggctgaaaaacggtatgtttgaatcagatgtttaaatccacttaagaaagggggagcactgcatgaacatcattatctgtaacgacaacctgccggaacggaccctaatgatagattacatccttaaatgggcctcggctaaatgcctggaaatgcagattggaacctgtaaaaactgggcggaactggctgctgccctggaaggaagggagtgggacctggttattgttgccctggacggcgtacggggcctggataccgcagccagtgcacagctgctctccaggcggcttatctggatttccgacctggatttcggggtacaggcataccgtatgtgtgtcagctatttcttcatgaagccggtcagctgccagaaaatgcagcgggctctggaatgtgccctggaagtacagagcacacagtaatatctggagggatgtttaaatgaaacagagacagcagacagatactgtcaggaagacgcgcagacagctggagcaggaaaattgtgccctccagtccctggcggaactggacggactgaccggactgtataaccgtatcaccatggagcgcagggtagatgaccaccttcgctgcaaacagcccggaaccatgattgtcctggacctggaccatttcaagcaggtaaatgaccgttacggccacattgccggggatatgctgctgtgcaccattgcgagcgtattgaaaaagatgtttaacgggcaaaatctggtggggcgcgtgggtggggatgaattcgttatttttataccctctattctggaggacgccaggacagccggtgaatgcctgcggattcaggaacggttccgcgaagtgcggctgggcgattccatcctgattaaactgtccattaccatagacagtgcagacagcctgacctgcagtaaataccgggatatgtttgactgtgcggaccagaaaatcatggcgaaaaaacgtcttcgcaacttaaagaacgggaccggctatgcatcccctgccagggagccggcaggcatacagcctgatatgagcctgatagccagggagatggaagagaaggaaatcccgccaggggcctactgccaggattacgaaacctttaaacaaatctaccgtctggaggaaaggcgcctcagaagggataaaaaaagggctttcatcatcctgtttaccctgacagaccggaataacggtttcctccccctggataaaagagatgctgagatggatatgctgggggaggaaatcaagcagagcctgcgcatgggagatgtgttcacccggtacagcagctgccagtacctggtcatggtgctggatgtgtccctggaaaatgtggatgtcattgcagagcgcatatgcagctcctactaccgggtacgccaggaaacggcagacaacctggttctgcaccgcagctatcccttaaagcccgcccgcagacgtcccagggcctgacggccccggcaggactttatcctgtcaattgcgcactggaacaacagcggcagcgcgatggcccatataagatacaccacacggaactgaggcagatttttgggaaaatagcagtaccagagatctgccttgtactgttcaaaactgaatcccacaaagagaggcgtgtactttgccatggccgcaaacagggttttcagtaccataagggccatgatatggtgcatcatcactgcatatgtatggcttccgaaataccggagataccggctgtcctcaaaggcccgggccaggatacggcataccctgagccagaatgcgatgcccagcccggccgtgatgtagggcagcaggattcccgtaaaaccgttgcagaaggccacggagtagatgagagggcggccggacatggccagaaccagctggactgccaggatgatgccaaagtacaggcaatggtccgccctgtccctttgctccagcttctccctgtacagggtgcctgcaccgtagcagggcagcaggaacatcatgcgcaccagtgtaagccatccgtcctggtaccgtccggagcgcgccagaaggatgcctccggcccctatggacagatacagaagaaagactgcatattcagaatccattccctttaaaaggcggcgcaggagcacattggccatctccaccagaaacagggcaggcacaaaccaggcagccaggttatattcaaactggtgtcctgtaataaatggctccgccaacagattccacaggttcaaatcccccccaaaggcaaaaccagccagatgaagtacctgtgcaatcatgccgtaaatcagattgtataccatatacggtcccagcagccggactatctttttcctggtgtatgcccccagccggttttcgcttccctttttataaaaatacccggagataaaggcgaacaagggcatgtgaaaggagtagtagggcaccagtccccctatatccaggtaactgttattgagatggccgtccaccacaaaaaccatgcccagggccgacagaatgcagaactgcatattgaagccgtcatgggactgtaccccggggcgcgcctggcctgcgttgcaccgtttctccgccccgcctgtcccttttccgtcaaatcgtccttctgccatgtccggcctccgttttatatatttttctgaaattagacggggtcatgcccatgaccgacttaaacaccctgttaaagtgagtgatgttggagaatccggtatcacggctgatttccgttatattcttatctgtttccatgaacatcctctgggcattcatcacccgtgtgacgttcacatactggatgatggtgctgttggtataccgcttgaactccctgcacaggtagtagggacttacataggacatctgggccagctggtcaatggatatatcctcctggtaatttttatggatatagctgattacatctgtaatccggttgcgcttttccggcttaaccggtgtctgtattttcctggcaatggtcaataacgccatgtttaacagggtatggatataatcctcatggtaagcctgaggttcatcctgttccttaagcaggtcgtccagcatgcggtgcacaacctgcttttcccgctggtccggcttatataccccggttccctgctccagcacctttaacagcggacgggaatccacttcctccctggcgaaatacaccaggagccgcttaaaaggcacattttcctggccgtaggagtggtgcatcacataaggggaaaatataagaaattctcccggatgaatgcagtagagctggtcctggatgatatggaaccgttcaccctcctccagatagtacagttcaaaataatcgtgatagtgggactttgacatattgtcattgaccccctgtatgcgttcgccggcaatgctccttccctgggccatcatgattccagcctggtcaatcaatctgtttccccctttctttggtacatatatccaattcccatgtttttataaccgtaaaatacacggaaacatcatagcgcttccaaattaatacagcaagatatgtttaatttcaaccataaaactgcaaatattgtctagtttaggcggccttaattctatatgataataacataaaaccggttgaaataaaacaaggaggcaacaatttatgaaggtttgtacgaatgcttacacagtcattaaaaaggataattacttttcagtgacgacaaacagtgtggaaatccgcattctttttctgactgattccatcctgcgcatcagggccgggtttgacggcgatttcgcagaggaatcctacagccttgtgatgacagcatgggaggaccggatggacgatttcctgaaaggccgcagaacacgggtggctgcagcggatgcagtcctgtcggacggggacagggaggcagtgattgagggaagcctcttaaaggtagtggtggagaaggacccgctgcgcatctgcgtatacgacaaagaaggcaccctgcttcacgcggacatcccagacctggcctatatggaggacagcaaccaccgccggattcacaccagcgagatttcaccggaagattgcttttatggttttggagagaagagcggtgatttcaacaaagcccagaaattcatgggcatgagccccaaggacgccatgggatacaaccctaaggaaacagactctctttacaagcacatccccttttacataaaattaagccgcagcaccaggaaagcagtgggatatttttaccacaacacctacgagtgcgactttgacatgggccgtgagaagagcaattactggaaaccccacagccgttaccgtacagacggcggcgacattgacctgttccttattgcaggcccctctgtgcggcaggtcgtggagcgctatacggacctcaccggcaaatcagccatgcttccccggtatgccctgggctatctgggttcttccatgtactacccggagctggatgaggactgcgatgatgccatcctggatttcatcgacaccacaaaggaggagaagataccggtggacggtttccagctttcctccggctactgcaccgtggagacagataagggtatcaagcgctgtgtctttacctggaacaaaaagcggttcaaggaccccagggaattctttgcccagatggataaaagaggcgtgtccgtatcccccaacgtaaaaccgggcatccttctcatccatcccaaactggacgaaatgaaggccaggggcatgttcgtgaaggccagtgacagcgacgagccgggcatcggaacctggtggggcggaaaaggcgtgtttgcagactttaccaaaccttccacccggacctactggaaggaaatgctcagggaaaatgtcctggaatacggcaccagttctgtgtggaacgacaactgcgaatatgacagcctggtggataaggactgccgctgtgattttgagggcaagggcggcaccatcggacagctgaaatccgttatgtccaatatcatgtgccatattacggatgaagccatccatgaaacctttcccaatacccgtccctacattgtgtgccgctccggccactgcggcatacagcgctatgcccagacctgggcaggggataacctgacctgctgggactccttaaaatataacattgcaaccatcctgggcatgagcctctccggcgtggccaaccagggctgcgacatcggcggattttacggcccctcaccggaagcagagcttatggtccgctggattcagaacggcatattccagccccgtttctccatccactccaccaacaccgacaacacagtgactgagccctggatgtacggtgactgcacgggctatatccgggaagccatcggcctccgctaccagttaagtccttacctctactcactgatggaacgggcccatgagacaggacttcccatcatggaacccatgtgcagcgcattccagaatgatgttaggtgctacgaggagggcgtggacttcatgttcggcgattccctgctggtagccaatgtggtggaaaaaggcgcctccgccaggaaggtatacctgcctgaaggcgaaaccttctatgatttctacacaaggactgcctatgagggcggcgccgtcatcgagcttcccgtggacctggggtctatccccctgctggtgagaagcggcgccatcattcccatggcggaagacaagcttgataacctgaaaacgcagcagacagagcacctcaggattctgtgtgcagctgaccgggacagccggtttgccctctatgaggatgacggcatttccatggactatgagaatggaagttatctgaagacagacataaccatgacagccggggaacgcactaccctggatttccaccaggaaggccattatgagacagctgtaaagacactgtatctggacatgattcaccgtgaaaaggctccctactgggtcaaggcggacggagaaaccattcctcatttcctccaccggagaaaattcgaggaggcggactgcggatggtattacagccagaggcttaaatccgttcagattaagtaccctaatcctaagaaggattatcaggtgattgtatcctttgagcaattcgacctgattggtatgtaaaaagcgagcatatgcttcccctcccgcttacagaggggaagctgctaccatagaaaggggatattgaaaatgaaaaaatttgcagcagcaatggcagtggctatgagtctggctgtgctggggctcaccggatgcgcccagggcggcgccaagaccagcgcagaagctaccgcagaaaacccaatggtgcttactctggcccacggcctcagcgagacccataccgtacacattgcaatgacagaatttgcagacaaggtggaggaacggacaaacggaagaatccaggtccgcatccttccaaacggacagctgggttctgaaaatgagaacatggagcagctgatggccggtgttatttccatgaccaaggtgtccgcacccggccttgccacctacaatgaatcctatcacgcctttggccttccctatatcttcgatgacacggaagacttttaccatgtaatggattccagccagatgcaggatttctttctttcctcctcggatgacggattcgtgaccctgacctactatacatccggcgcccgttcattttacaccaagaacaaggccatccgcactcctgccgacttaaagggattaaaaatccgcgtgcaggacatgaaatcccagaccgatatgatgaaggctctgggcggcattccggtggccatgtcctacggcgatgtatacacctccctccagaccggcatcatcgacggcactgagaacaacgagacagccctcaccacgggcaagcacggtgaaatctgcaaggtatactccacggaccagcatgccatgattccggatgtaatggtcatgagcgccaaggtatggaaaaccatcagcccggaggaccagcaaatcatcctggaagcagcccacgaatccacggaaagccacaaaattgcctgggacgccgccattgatgaggccatccaggaagcatccgcccagatgggcgtggaattcgtgaatgatgttgacaaggatgcgttccgccaggccacaagcggcatgattgaccagtactgcgcacagtatccgggtgtgaagaagctgcttgacatcattgattcggtagaataaaggggaggtaatcacatgaatgaactattatctgtcatcaagaagtggatgacccgtcttctggccggcattgccactgtgctgctgtccgtcatgacccttctggtcctgtaccaggtatttacacgctacgtgcttaacagccccgccgcctttaccgaggagctggtgcgctactttctgatttggaccggtttcatcggagctgcctatgccttcatcaccagggagcacatgtgcctggtgctggtgcgcgacagcttaagcccggcaggccgccggattctgatgacagccatcgatgtgctgattctgctctttgccatctttgtcatcaccataggcgggttcaagctggcattaagcgcccagaaggtattctcagcgctgcttgggattcccagaagcctggtatatgccatggcgccaatctccgggctgttcatcatcctggcacagattatcaatatctatgaggatgtaaccggaatcaccattgaaggagggaatgagtaatgagtatcggacttacaacagttatcctgtttgcggtatttggcatcctgctgttcctcagctgcccaatctccgtcagcattgtaatcgcttccatcgtaaccgccatctccagtctgtcctgggaccagattaccttcatcaccatgcagaagatgaacagcggcgtggaaagcttttccctgcttgccatccccctcttcatcctggcaggcaatatcatgaataacggcggtatcgccagacgccttgtaaactttgcaaagctgttcgtgggctggattccaggctccctggcccaggccaacatcgtgggcaacatgctctttggagcgctgtccggttcctcggtggcagctgcatccgccatgggcggctgtatctaccccatccagaaggatgagggctatgacccggcctttgcaacagcggtcaacattgcctctgctcccaccggactgctgattccccccaccagcgcctttatcgtgtactccacggtagcgggaggcgtatctatctccaccctgttcatggccggatatattcccggtatcctcatgggcgtcggctccatggtagtggcctttatttatgcgaaaaagcataaatatccggtatccggccgcacgcccatgaaggaagcagttaaagtgaccctggaagccatccccagcctgctgctcatcatcattgttatcggcggtatcgtgggcggcatcttcactgccactgagggagcaggcatctgtgtgctatactgcctgattctttccatctgctataggagccttaccatgaagtcattcatgaagattctggtaagcagcgcatgcaccagcggcatcatcctgttcctgatttccgcctcctccgccatgtcctttgtcatggcatactcaggaattccggcagccatcagccagggcatcatgtccatctccaccaacaaatacgtgatactgctgctgatgaacataatcctcatggttgtgggcatgttcatggacatcacgcccgccatcctgattttcacgcctatcttccttcctatcgcccagagtttgggaatgagcgatattcagttcggcgtcatgctaatcttcaacatgtgcctcggcaacatcacgccgcctgttggttccgtactgtttgtgggctgcggtatcagcaaaatcagtattgaacaggtgaccagaacactgcttccctactttgcagtactgttcctgctcttaatggccgttacctatatacctgccttgtcactgggtattcccagcctcatgggattgatttagtggtattatgagataagcctttgtatttaaaaaaagaggtcgtccgggtatttcgcccgggcggcctcttattctctacagcaccttttccaaaaatcctctggccctgtcactctttggattcttaaagaactcatccggattggcatcctccactatctgcccgtcgtctataaagcagatgcggtccgatacctccctggcaaatcccatctcatgggttaccagggccatggtgatacctgtgtgggccaggttcttgataacctccagaacctcctttaccatctcagggtccagggcgctggtgggttcatcaaacagcataatctgcggctccatggccagggccctggctatggcgattctctgcttctggccgccggacagcttacccggataggcatccgccttctccaccagccccaccagcttaagaagctccagagcattttccgctgccttgtccttggaaatcctgttcaccttcaccggggcataggtcatattctccatgaccgtcatatggggaaacaggttaaaatgctggaacaccatgccgatgttctttctgaccgcctggatatctgcctttggaaccgtgatatccgtgccgtcaatgaacacctgccccctggtgggtttctccagcaggttgatgcaccttaggatggtggacttgccggaaccggaagggccaatcagcgtaactacctggcccttcccgatattcaggttgattccctttaatacttccaggttgccgaagcttttatgcacatcacgaaactctatcacttctgttcacccacctttccagacggctggcaactgccgacaatatcatgacaaatacgtagtaaataacggcaatgaccagataaggttcaaagaaccggaaggtcaggaccgtaatctggtccgcagcccttaagagctccaccgcgccgatgtaggacagaatggaagactccttcagcagggcaatggcctcgttcaccaggctgggcaggatatgtttcacggcctgcggaatgatgatgtccttcatcatatcaccgtagccaatgcccagggacatggacgcctcatactgtcccttgtccacgcccatgatgcctccccggaatatctcggagacataggctgcggagttcagtgtaaatgtgaggattccggactgggtggtggtcagtgtgaatcccagcagctgcggcagtccaaaatggacaatacacagctgtaccaggagaggcgttcccctgaagatggatgtataaaaccttccaaaccatatgagaggtttatatttgctgattttaacaagagccagtacgatgcccagcaaaaaccccagcacggcgcagatggccgtaatcttcagggtgagcagtgctccatggtataggaatggccaatattgccagacactggtaaaatctaatttcatatgtgcagccccttcttacattgccttaatctaagatgaactgttcgcttaaatggcttgcgatgatttcatccagttctccgttttccatcatttccttcagcgtgttgttgaatgtctcataataaggggattccttggggaagccaatggcaaaacagtcatcatccaccttatccataaggctcagcttaaggccctcattgttctttaagaactctgttgcgcctgcgccgtcaacaatacacgcatccgccctcttactctttacttcctcaatacaagcagggcttccctggatgccaaccgtctcagcgccctccacgctctccgctacctgctggtaattggtgccgaatacataggcaatcttcttgcccttcagggaatccaaatccgggtaattgtcctctgccctgtatacaattgcatttctgggatagaagaagatttcgctgaaatccagtgttttctccctctctgccgtaggcgccatgccgccgctgcagaagtcaatctgtcctgcctggatggcagccatcagacttttaaacggcatatccacaaactccacctggccgccgttcttctccacagccgcctttataatatcaatattcatgcccacataggtcttgcttccgtctgccgccatctcgatggactcaaagggaacgaaggtagcggagcagcccaccttcacagtcttaccggaaaacggattctcagccgctgcattctctccggctgcatccggcttgtcctcagagcctgctgcggtatccgctgcgtccttgcctgccccgtccttgtccgctgtctcctgggtggctgcctgcgcagcagccgtggtggcatccgccccgccggaacatgcggtgagtgcgcctgctgtcagaacagcgcacagcaataatgcaatttttttcataataattctcctctctgctatatgtatataaaaaataaaaagtctgcattctgcaaaccttatcccctccctctgccttaccggcataaataaaggaagaacttgcataatcatagcataaatatgcatcagattcaatagattccaggcttttttctgccccccatccgtgctataatgaaaaccggagacaaatagcagaaatgaataaaaggagcaatttaccatgtcatatgaaatagacggcaggacaaacggacctgccatggcctggcccggccgcgccaggattgctgtcatggtcacctttgactttgacgcggaattcctgcgcatgtccagagccgcttccaaaggcgccaccattggttttacggattattcccggggccaatacggcccccgggagggcctgagacggtgtctggatatgctggacacccatgatatcaaatccaccttctttgtacccggaatcgttgcagaaacctaccctgaccaggtggaatccatccatgcccatggccacgaaatagcctgtcacggatacatgcatgaatccgtccgcggcatatccagggaagaggaaacagaaatactggagaaaagcgagacaatcctggagcgcatcaccggcaggcgcccggtgggacacaggggaccggaaagcatcatccatccctttaccccgaagctgctggcagagcgcggttacctctacagctcttccatgaaagactgcgactgggcatatctctggcagcaggacggtcagacactgcctctggtggaactgccgtgcgacatcaccatggacgactttacctatttttatttcaccttcagcgaccctgccgtgcgctccatgtacagcaaccgtgaggtattcggcaactggaaggatgaatttgacggcctggcggaggaggggaataaaattttcgtcttaaagctccacccccagatgataggacgcgccagccggattgcgaccctgggaagcttcattgcctatatgaagggccacggcgcatggattaccacctgtgaggaggctgcgcggtatgtactgtcccaggctgaatccgatggagcaaatcatgaaaaaggaggtgacgccctatgatggcctggcctgacaataagcgaatcgctgtcatgatggcatttgacctggacgcggaaaccatgtggaccaccaggggtgatggaaaccacgaccatataaccaatctgtccaggggtgcgtacggacccaaacagggcgtacccagaatcctggacatgctggatgtgtatggggtgaaggccaccttcttcattcccggcgtcatagcccaacaatatcccctggttgtaaaggaaatcagccgcaggggacatgaaatcggattccatggatatcttcatgaggaatccgcctccactgcctatgaggaagaggatgccaccatgacccgctgcgaagccattataaaagaactgaccgggcagtccattgcaggccaccggggtccgggaggcgtgatacatgattacagcctgaggctgtttctggagcacggctatatatacagctccaactggcgggactcggacggcccctttatccacaggatagacggccgggaggttccgctggtagagcttcccaaggactccatctttgacgatactgcctacgatttttacacggattccgccccggagcggtatgagctgaaatccccccgggaaatgcttgaaatctggaaggatgaattcgactccctggctgctgagggcagaatgattaactttgtcctccatccccagttcattggacgggccagccgggtaaacatgctgggggagcttataggctatatgctgtcccgcggggcgtggattgataccaaccgggcagtggccgagtatgtgctggagaaccggaatctattaatgtctgactgataaaccgcatccagaccctgttcatggctcagaacagggtctgctgttcgtactcgcagtccctttccagttggggcggttcctgccccagcagttcttttgtcttaccgctgtccagaatccattcccttacctgttccttttcaagtaccagaggcatgcggctgtggacaggggccatggaggcattggcctgggtggtcagaatgacaaagcggtctccgtcctcatacctgccgtaaaatcctgccagaaacaggacacggcttcccgcccttgtaaatgtaaacttctctttattcccattccactcataaaaccaggaaacagggaccgcggcccggcgcagcctcacactgtcccggaacatccgcttctcaaacacggactccgacctggcgttaaaaaccagccctttgccgccgggcccggggtatccccatttctggcggcaaatacagagcctgttgtccgggccttcatctgctgccgccgcaataaccggcgcagtgtcgcctgggcggatgtcccggtccagcactcccagctccagcttccagtccctctgctctgttaagtcccttatctcatccaataattccatactgaaatgatatctgccgcacatgaaatccctgcctgccctttcgtaaatattctatccttaatgggtattatattctttataaatattctacccttaatccctattctgtccatatagcggtattttacccgcctatctcactgcttccaatattccctcgctaaatgtgggatgtgggaaaataaccttagccatatcctccagcgtcagtccattggcaatggccaccgcaaactggctaatcatatccgtggccctggcgcacatcatctgggcgcccaggatgcggtgggagccgctgtccgccactacctttatgaatccccgttcctgctgggacagaatggacttgccgttggcggacataatatatttctttgtcacggtttctatcccccgggccttggcctcatctgcactgattcccacgcagccgatttccgggtttgtatacacgcaggacggaacaatatccgtacggattgccatatccctgcctgccatatgggtcactgcgtttctgccctgggcggtggctgcgtgggccagctggatgcctcccgtgacatcgccgatggcatagatacccggtacgctggtttcatatttctcatccgtgacaatgcgcccgcgctccatttccatatccttcacttcctggctgctctcatctgttatgagaccgcctgtataggccctgcgccccgtggcgataaggatgccgtcagccctggcctcgcagggtttgtccttttccgtatagcggcatataagcccggacccatcctctgtctgaaggatttcctccacctttgcccctgtatggatatctacattcctttttttcataatcatcttcaggttctgggcaatctccttgtccatagtgggcaggatgcggtccagggcctcgattacggttacgccgtggcccagcgaactgtacacagacgcaaattccataccgattaccccgccgcctataataatcagatgaccaaacatatccttcttgtccagcagcccgtcgctggtaaccactcctggcagcgatgcgccgggtatgggcgggcatgcaggcacggaacctgtggcaatgagaatatggctggtttccagaataatctggtccggcctgtctccggcctcttctgccggcgccaccttcacatgctccctgtccagtatgactcccgtaccgtaataaacagaaatcttgttggttttcataagtgaggcaatgccctttctcaactgttccagtacctcatccttccgtctctggaccatctccatatcgactgccgtgtcccggactgtcagtccaatggatgggcctgactgtaattcatggtacagctctgctgtatggagtattgttttggtgggaatgcatccccggttcagacaggtgcctcccagctcacggttttccaccagggcgaccctcatcccattttccgccccttcaatggcagcctcataaccgcccggtcccgcgccaatcaccaccaaatcaaatctgtcagccataataacttaacctctcttccattcatgttctgcgtttacagcgattccctgacaagggccttgatgtcctcttttatcctgcatgcctgcggtatgtccgccctgttttcttcacctgcggcctctcctgcctggaaggcatccggcccaagggcttccactgccctgcagatatcttcctccgcataggcgcagccctttagctgttccgccaattctcctatcatctcctggtccatggcatcggagaatacattcacgtcctgtatcactcctgcatccacatggaactgcatctgtatattaccccatggaaaacgcttctccatctcgtactcaaaaggaatctttctgccgtatttccactgccaggatgcaaatttctctgtcagtgcatctatgtccggctgaggcagctccccttcctccatgcggactgcgggcagcccgtataccctggaaaatgcctccaccagtgcggattttacttcctccaaggtgatatccggcttaaactcacataaattggccaccctggatttaaccgaggtcacgcctttggaggcaagcttttcctttgacacattcagataacgggacatattttccttgtcggcccgtatcaatatggttccatggtggtagcagccgtcaccggtgcggtaaaatgcattgccggaaaacttgcgtccatccaccgttatgtcattgcgccctgtcttctcagcatggatgcccaggctccttacagcctccagtatcacatccagctggcgcgaaacattataatcctccgccccggcaataaatgtgaagttcaggttgcccaaatcatggaacaccgcgcctccgcctgagagacggcgcaccagatagccgtcctcctgctccaggaagttcaccctgcattccctccagcaattctggttctttcctatcaccaccgtatggcggttctgccacaggtacatgatgcaggttcccttgggaacattgagggtcatgtactcctccatggccagattccggtagggatatgtattatctgtatctatccacacaagtctgtttatcatgtcattctccatccttatagaaaggctgcctgggcagtccgttccccggccgtatacagatatcacggatatccgtacatgaccaggaacataccggctgtccaggcagtcctgttacattttcatcatcattcccaagtatagcgcagtaccggcttacgtgccgccgtaacctcatccggtcttccaatgggcgtcaggtgaggcgcgctgtgaagtgcctcagggtctgccagggcctgctcgtaaatcttgtggaatacctcgatggcttcatccagtgtttccctggactctgtctctgtaggctccaccatcagcgcctcatgtacaatcagcgggaagtacatggtcggcggatggatgccgtaatccagaagcgccttggcgatatccatggcagacacatccttgtcatgcttcatcttctccaggctcataacaaattcatgcatacatgtctcattgtaagccatatcatagacatccgacagctttaccctcatatagttggcattcagcactgcattgcaggctgcctccgggatgccctcctttccaagggtcaggatgtaggacaatgccttcaccaccaccaggaagttgccgtagaacatcttcacgtccccaatggattcctgtgcctttacaaagtgatatgtttccccgtccttctccacccgtacgcctggtataaagggctttaagaattccttgcagcccacaggaccgcttccaggtccgccgccgccgtggggtgtggagaatgtcttgtgcaggttcagatggaccacgtcaaagcccatgtcgcccggccgtacaatgcccatgaccgcattcagattagcgccgtcatagtaacacagtccgcctgcatcatgtactattttagtgatttccagtatgttcttgtcaaataatccaacggtattgggattggtcagcatcagaccggctgtgtcgtctcctaccgctgcctttaactgctccaaatccacacagccgtcctccctggacggaatgctcaccacgtcatagccgcacatggcagcgctggcaggattggttccatgggcagagtcaggcacaataatcttggtgcgcttggtgtcattgtgatgaacgtggtatgccttgattaagagcagtcctgtaaactcaccgtgagcgcctgccgctggctggaatgtcattgcatccatgcctgtgatttcgcagagatatttctccgccagatataatacttccatggagccctgcaccgtagcctccggctgcagcggatggactcccttaaatcccttcaaggcagctgcttcctcattgacttttgggttgtacttcatggtacaggagcccagaggatagaaaccgtcgttgacaccgtgggaacgctttgccagctccgtataatggcggctgatttcattttccgacatatgcggaaggcgcggctgtctctcacgggtatgtgctttttcaaacgacacctggggcacgtcgcaggggctgattaaatccagccttctcccggctgaccctttttcaaatacaagtttcatgaaccgcacacctccttttgtccgcattccctgtgaagcgcctcccgtacagctgaggcaagctcatccatctcttccctggtgttcatctccgttgcgcaccagaggatttccctgtcggacaacggcagtccgcccagtattcccttgctttccaaagcccttaatatatgggcgctgtccgtacacttgccctccgggcttacggttacaaattcgtggaagaattcacattcatgctttggctcaagtcctgcttcctttaacacgtccctgagatagtgggccttggacatgcactggtccgctgccttagccatgccctctgcacccatggccgtcatgtatacagatgcagtcagggcacaccatgcctggttggagcacacattggagctggccttttcacggcgtatgtgctgttcccgtgcctggagggtaaggacaaatgccctgcgtccctggttatcagctgtctctcccacaatacggcccggaagcttcctggtcatggctgccgtggctgtcatgaatcccagataaggtcctccgaatgccagaggcataccaaggggctggccgtcgccaactgcaatatccgccccgtattcagccggcgtcttcataacagctaacgccatcgggttgcagcccatgatgtacttggctcctgccccatggacaatgcggcccagggcatccccgtcttcgatattgccgtaatagttgggctgctgtacatagaagcatgctgcctgcgggtccgccttcagaagctcctccagggctgccgcatccgttaccccgtctttttccggaaccatgacaacctttgtattgctgccaaagcagtatgtcttcatgacctcgataacgcccgggtttgcagccgcggaaatataggctgttgttttctttctctccttacacatggcaatggcttccgccgcggctgtggcgctgtcatatatggatgcgttggaggcatccatgcctgtaagctcacagagcatggtctgatactcaaatatggactggaggatgccctggctgatttccgcctgataaggcgtataggctgtgacaaactcctcttttgacgttacacttgaaacaatggcaggtatgtaatggttataagctcctgcacctctgaaaatatggcggaacacaacattcttaccggctatgtcctccatcctgctcttaactgcctgctcgctgagtcctgaagggatattgaccccttccttcagcattacctcatccggtatatgggagaacatctcctcaaagctggcaaacccaatttcacgaagcatatcctgctgctcctgcttcgtacctggtacataacttcccatataatctcacctcacctctcatgggatggaataccttccccgtcttaatttaataaatctctgttccgggctaatccgtattccaattaatccagggtcttcacatactcctcatactctgccgcgctcatcagctgcgctgtgccggttacattctccaccttcatgaaccacgcctcataaggcgcctcattgatggattccggagcgtccagcagaccctcgttgacctctgccaccgtgccgctgaccggtgaatacacatccgaaacagcctttacggactccacatctgcaaacgactctccctctgtcacctcgtctcctgcctcgggcaggtttacgaataccaaatccccgagagcgtcctgtgcataatctgacagtcccactaaaacagtgccgtcctccagggtctttacccactcatgtgacttcgcatactttaaatcttctggaaaattcattcttaatacctccttgaacatgctgttctttattatatttataaatcatactttttatatctgctgtaccgttaccgtttataaaatggcagcttcaccacctctgcagccacgcgtcgtccccttacatccacttccagtgcggttcccggctccttgaatcctatgtcaaccagggccatggctgccggatatcccaggaacgggcagtgtgtgccggaggtggtcatacccacctgctgttcccctatgtaaacaggctggtgctcccggatgatgccccgtccggttacctttaatcccacacgttttctggtcagaggtcccttgtcctggatggcctgttttccgatgaaatcatccttatccatcttcacaaaaattcccagccctgcttccttgggagaaatggtatcatccatctcatgaccgtataaaggcatgccggcttccagtctcagggtatccctggcgcctaaaccgcatggaatcagtccctcgtcctttcctgcctccaagagcagttcccacatcttaggagcatcctccggtgccagataaatctccactccatcctcccccgtgtaaccggtcttggatataatgcatttcatgccgcccaccatgcggtcaaaaaggcaggtataatatttctcaggaatgtcctcctccctggccaccttcttaagcacatccattgcctttggtccctgcagggccagctgcgccacctgggaggaaatgtcatcaaatacaacatcccccgactgatgggccttcatccatgcatagtccttatccttgttggatgcattgaccacgataaaatagcagtcatccctgaccttatagacaatcaggtcatccaccacgccgccctgttcattgcacatggggctgtacctggcctggccctctgccatgaccgtatagtcattggtgagaagcatgttcagattcttaagcgcgtccggtcccttgcaaatcacttcccccatgtgcgacacgtcgaaaagaccgcacttggtgcgtactgccatatgctcctcgatgacacccttatcgtactgtaccggcagaagataccctgcaaaaggtacaatcttgcccttatactttacgtgtgtgtcgtagagaggtgtttttaacaaaacctcccctgttgcttctgtgcccataatcactacctccttcatgaaattgtctggtccttaacaatataagattatgaaagcgcacgaacaaaagatgttcatgcgctctgtccttggacctgaaagatttggcttcttcggtgctatgctctccagagtatcgtccggtatccggtccttttgcctgagagttttccgcttccccttcggcgctgccccctgggtgtctgaatatacgtggatatgcagtttcccgcatctcctctatcttccgcccatggctgtcagtctctcccgaatccatcttccgatgatataaaattgtccgcaaacgcaattcccaccggcttgccttgtgctaatcccatactaacacagccgggattttcagtcaatagctaaaaggtgtttaaattttaacacattaatcgcatttttcgccttattttccaaacttattttcacgaatattttacggtttatttagaaaaaatactggtaatctcctatgaagtagtatataatgagcaaaggtgatgaggcgaaggggttcctttggcctcattcttgtatgagtacggttttaactgagcaaaatctcaaatgaaagaaggtgacaagatgcataagtttatgcggacagtaggattcagtatgtaccagaaaaaacaggatatggcgaagcttttaaaacgcctggtaaaggaagcggagatgaccggccacctggcagaacaggagggcagccgcctctgtgagctgcgcgcagaagtggctcccggtatgggagttgccatgataggggagatgagtcccaagggtacgttcagccgtgaatattattttccctatgtcaaaaaccaggatgtaagttcagaggcagaatgttccatccagcgtcacacggagcgtgaaacttatgcaggccttcttgatgaatacagggtgggcatatccctgattttctacatggagaattccatggagtacaggatgcgccgcaaggcccgtcagcctgtccagccaaagggtgctgcccttgcgggcctggctgttcagggaaaggtgctgctgcctgtgaataaaacggaaaaacaggccgaggattcccggcaggccgcccaaaaacgcagcagcctcctggaggcagccaagcacggcgacgaggatgccattgagaccctgaccatcgaggatatcgacctctactccatggtttccagacggattgcccatgaggatgtatactccatcatagaaacctgtttcatgccctgcggcatagagtgcgaccagtactccgtcataggggaaatcacacaaatcaatacgattgccaaccggattaccaaggaagagatatatgacctgaagctggactgcaacgacatggttttccatgtggccgtcaacaaacaggacctgctgggcgaacccaggattgggcggcgctttaaggggcaggtgtggatgcagggcacggtgctgttttaagcgcgggacggaatatggattggatattcccggatattggttcaaggcgtcccagggtgaattggggatgtttatttaaaaataggacttgattttttttaacacataggttatcatataaggcggaccgcatgagtatcatacggcccgccttatatttgtgtttctgtagctcagcaggatagagcgtccgcctcctaaggttatgctctaccggccgccttacgatgaaaagtgatcgttaccaattttaattgaatagatgtctctgtagctcagcaggatagagcgttcgcctcctaagcgaaaggccgtgggttcgaatcccgccagggacgccagcaaacacgccgaaaacctttgatttatcagggttttcggcttttcttatttctgcggcttttgtggcttttttgcaaaaaaacttggtttgctaacatttgctaacgagatttggccttttgctaagaaaggcggtaagtcagaggttcgatttttaccaaaggaacttgcaaacatttgttagcagaaattagaggaagttgcaaacaaaatcgcgaatttgctaacatcgctcaaaaatgctttcagaaccttgctaacaaaaaaagtgtttggtcactgtgcaaagtggttcaaacgaagaaaacctctcacaaagtgagaggcgttcttctgagggagggactttataaagcttttgccagctgcttgagcagtgcggcagtttcgggatttttaagcagttccagtatcttcgctgcatcactttcatcactttcagtgacggcagtatccgcagttttaggctctgtatcttcaacagggtcaggagtcttggatgagtaaaatgcttcctccaatcgctgagcgtttatgcagcgatcctcgtcgatgatgtgagagtagacatctgcaaccatttttacctgagcatgaccagagtcgccctggacggatttcatatcgccaccattgagtttcagcttgtaggtgatactggagtgacggagagaatggaatacaacatgaggcagtccgttttctttgataagtttattgaaagcacggttaatcacctggctttccatcggacggccattgctggagcaaaagaccaggttattgtcgatgtattcatctccaaacagatccatcagctcatcaatttctttttttctctctaccagcatataggcaactgttttcggcaggtacacgcggcgaatactggttttggttttaggctctttcaggaccagagcagtatgggtactggctatgcaaggtggaaacttcttaataacacctttgtcgctcaaatcgtccaatgcacctcgtgtaacccgttgcagctctttgttgacgaatatataagctgaaccattttctatgctctgtggtgcaatatcaatgcagtcccaggtaaggcccagcatttcaccaatgcgtaaagagcaggagaacgccagatttaaggcaagggagaggataggatcatcacagacttccatagccttgctcagcgtttcggcagtccatatatcccgttctttatgttcttctttgggaagtgtcgcattcaggacagggttacggctgattagttcccaacgcaccgcctgattaaaggcactgcgaagtagcttgtgaatttctcttactgtatgcggggtcagatattcgcttgtgggtttgcggttgttgacgcttaccgttttcacagagagcagatcacggtaatacttatccatcatccttggagtgatgtcggatagtaacatatctccgataataggagttatgtagtttctcgccagaccacggcggctttcatatgttgacattgcccaggtatttacaccatagatggacatatattcatcgagcagatcgttcagggtctttgccgtaggaataaagaaggttccagagtcctgctcatactcaatttgcttttttcgtttttttgcttctgcatttgtgctgaaggtttcccaacgctgtctgcgttttccgttttcatctgtgtaatcatacaccacagaatatttgcttttacgcttcacgatagatgccattttcattgctcctttctgagattttcacataatgagtttgcttttgataccaggcttcaaaactgctggtaatgatacgaattcttcgatcaatcaaggtcgtctcaaaatagccccttttaacaaggtcataagctgtgccagatttcagccccaaaagatccgccatttccggaactgacatcgtagtatgcctccatttctctccgggcggtgtaccatccacttttttatagtggaactggccggcataccaatcttcaaagctatccagcataactctcattcgtccggccacttgaattgttttgaaatagttctttttaaccaaccagtaggattctactttaccaagcccaagcattttgcccatctctggtacagacatactggtctttactctttgtttttgcatggcttttgcctcctctataaagtttttcttgctatggcctcattgtaagagaaagcagaaaaaaagttaaggatgtcgatttggagatcggcatccttgacaaatcattcatctgcgtgatccagccagtcatcaaagctctttttggaaatgcggatatgaccgccgactctgacgctgtggaatacaccctgttttaccagattatatgctgtgggacgactgatacccagaatgtcctgaatctcatcgaccgtataggttcttttgtcatagctgacaggattttgttcattaaagcggttcaattccgcaattcttgcttcaaacataaaaacgcctcctttatccggtaagtggccttacggagcctccatttcctccggaatatgaatatctaaactaacttgcagagcatcatcaatcgctctcatttcttcgcgagatacgcgcccaatgtacgataaaacacgccttttatcaatcgttttaatttgctccagcagaacaacagatttcagtccaagctctggaacgctctccagtgcatagtgtgtgggcagttcctttttcttaatccatttactggtgagtggagctacgatcaaagtggggcagaaaaaattccccacattgttttgaagaaccaggacaggacgggtgccgccttgctctgatccaaaataagggttcaaattggcataatataaatccccacgcttataaatccaatcttctttcatgttcatcctcctatgttttgagatttgattatgtaagaaggaggctctgcaaattacagagtctccttcaatttagcgcctgttttatcccttacttgtccacgacaccccagggatttgggtaatcattaagccgcaggtggctggcctgcttctcaggagtttcacctccacttcgtttggtcttacccatggcctgcgacggttattatcacgctcggactatggctgtaagagagctttcctccttgttatgccatgaccggatgccatccgatgtattccagcctgatatatttctgataaaccgaaaactcatctatacagcaaaaatgggttggcctgttatgcgagtggcagctctcagaaaatataccgctgatgtagcggctattacgcccaaagaggatcaaacttaatgattcgtatatgaggttgtcaaggtgcaagtgaaaggatttccctctcacttgctactgccacttttttagaaaatcgcaaccaacttttttattttttcttcaatttttttcaatcgcttatctgcggcttgccgagtaataccatatcgttgggctaaacaagttgcatttggtattttcatttcataataggacaatataaaatctcgttctgctggactcagtttcaatagagcttggtgtaaatcctcaagaagtaaattctgaatagcttgttccgcagtatcaacagattcatccacaaacaaatctgtatcctgataaccttcctctgtgccgtcacgatctcccacatgagaagccgggaatatagagcgacttttctcatgttcctggagatagcggctgtggcggtcctcctgttggtatttttcaaaatctttgcgagaacattccatgataatgcggtcatcttcatcacggaacattttgactgtttcaacaaaaaagcgcccagtaaagcaaccattgcggcgtgccttactgaacgctgaaaaactgatttcctcccattcctgtgggctgttatttttccaaatgaatactctcgtcatatcctttcctccgttcaaattcttggtagtcagcgaatttgaacggtgtcatggatattttgctatgtacgcctcccagcgcataccggcctcctaataccgggcaaagaaaaaggccggaagtgttttcacctccagccatgttcctgccgccatattgcagcaggaatgaaaaaagcccggttaatgccgggccttatgtagaaaagtattcaatttagcgcattcctgccactataacaagtatagcaggtcggaagtcggaagggagtagggattaggtcggggatttgtcgggatttagtcgggatttagtcggggcagctcctccaggacttctggaatagaatatccaaacaagcaaacagaaaataaatagatggcttctcgttttcggtcataaaagacactgcgctctatatttagttcttccagcaattctttctctgtactgttgaaccgatagataaattgcttagtcaaaatttcatagtaaagttctcctcgatccggataccgtttcagacgaaggagtgcacggtcaataatattgactagcatttgattttgaacaaggcagcaaactttttcttcaaaggcttgcagttcaatatctggtgcaaaattttcaagatagcagaggccagactctatatcttgttctcccataatccaagcagtttcttgtaattcttctgcccgttcactcagaacccagactacatcacggtaaatctttagaatcagcttacttctatgaaacgcagcgtcgctgttaagccccaaagctgttagcctgctgttacatttttggattgttgtgctttcttttctcatagaacatccctccttgttcgcaatattgcgaacatattaggtacaaaatagcatagcagaggagcgtgagagagggcagtgcctctctctattcccccatttggttatatcaggtttctggattttagacgaatctgcattgcttgcttggaaacctcaaaaatatttgccatttcagcaatgagctgttcatctgtccggcctattttaagccggtaaaaacattttttgatctgcggtaaaggcatcagcagagcagaagccagagtatccgcctgacgctcaattatgccatgactttcgtcggaagaaacatttccgttataagcagcaacatctccagtaccagagtacaacttcttatgtagtacccaatgagccagctcatgggcacaggtaaaacggagccgccctaattttgacggatcacaaagccgttcatcaattaagattgtaccggctcttactgcaatcattcgatactgtctctgtatctggtcatataagacaacagcaccgtcatcgaaaattgtttcccctaatatcttggggttttttcttagtgtatgaaactccaggattagatcaaactttgtctcgataatggtttcgattggcacaggacatggttgcccggatagcagagagggatcatattccatcaggatttttcgccctactgcctcgattgcttctgtacggatttgtggaattgacaaagctctcccccctatcgtttacgctcctttagcattttcataaatgtctgccattcttcatcggtagcatctacttcttttgccacacgcaaggctgcccgaacaatatctttttccatgatatagtctggcaaatcagcagatactgtattgcgtgattttgcagccagatccaaaagcaactcatgttctgatttatccaaattcagaaaggcagagatgcgttccacaaaatctccattgggtgcaggacggcggctttgctcaatatcacacagataaccgtaagcaatattcaaatgcttggctgtatcgcgtaaattgaatttgtgcgccttgcgtttctcggctataaatgatccaaaagttatattgcccacagcattcacctctcatttgttcgacgaactgcgaacatcttgcttatattgtatatcgaacatctgttcacttcaaggataaaaatttcatttgaaaagaggtgttaaaaatcaataacacctcttttgcgctatataaattcctgagcgatttgctgcatttccgtaatgcactctttgggagagagaatttttattttccctttgaatttgaatatccagccataaaaagttccactggggttcacttcaattttggctgtgaagtgtgtatcatcatacctatcaacagcagcatcttctccataatgatctatgattactctcatcaattcgttttcacatagaagggttacttccttcgatgactccgatgtaaacatatcaaccattttatttgtataggaggctacatcaaatccctctatcggcataaagtaagtttccagattttctacacttgttagccgatctacacggaagtgagcaattttctgatgcttcagagaaaatccaatcaaatagtaatggtcatttttccattcaagcgcataaggatttacgacataataatatccatcatgctttaagattttctttttttcttgagtatattcatagtattggaaccgaatttgctgatggtttccaatcgctgtttggatattgtcaatgatgtagtaaaccttttcattatgcggtttgacacggctggataaagcagcaaatttttgaagctgctttgcctgatgtagactggtcagacggcataatttctgcaccagctcctcagacttcttggcagaaatgatcttcgaggatgctactgcgtctgtcagcattttcagttctggatactcaaacaggcggtttcccataaaatattggttttgggtactcttaaccaccacaatatcaatccccgcatcgatcagcgcattggtatctgcgtaaacagtctgccgcactgcctgaattccttttccattcagatgggcaatgatgtcagatactgtggcgggatggttttcatcggtccgctcatagagaaaccggagtaattccagtatccgcatatttgttgaattctgcatacttcacctcctcgatttttaaaatggcctattttgtatgatgtccagccccaaagaccaggaacagggcaaccgcacagagaagcagaaccatccaattccggtctacgatcagcttgatcaccgccacaagcagcattccgcccaccaggagcacaacgccgttcattcaacgccctcccgcggcatattcgcccatgtggatgtccagcacccctctgggcggctggatcagggcgtcctcatactggcacttccactggatctcccgacacatccggccatccgccacgccgtctatggtttcaccatcctgaatggggttatcatgttccaatatgtacgatgccacattgtaggcgtggtttaccacccagttggggtccatgtcgtggaagtggtattggaggtcgggcaggaacagggtgctcatgcccaccgtgtcgatgagcatatcctccgtgccctcgatgttaaagaagcggacattgacgccaaagcggatgaaccgatccgagccttcaatctggtgagaacgcacatcctccgccagaaacagtttgccgcagttctggaaatagaatgcctcacaggtggggtacagctccgccagagcctccaaaaagtcggcatccaggttggcacgctccagcgtagacatagccacaaaatacgctatttcttaaattttaaatttcgtcactttgccaatactgatttatgatacctctgaacagtaactcggaatcatatccatggtaatcaattccgcccaaagagccgggcaatccattgccggccgccgtcctcccgccctgacattatacctgcatggcctgctcataaccgtgaagatattttaaactgatttttcaatatctccacaatatcttcaatggctttttcctgtcccgggtcaagaccatccaatacaatgaccttgcggtggtccagtccaagaatataatccgtagtggtacggtataaaacggaaagtctggacagaacatcggtagatggataggctatattgttttcatagttactgatagaagaccgcgttatatttaaatgggcagctacctgtgattgagacagattccgtctctcacgaagctcccgcagcctgtaaccaaaatcataaaccactacggttccccctttcatattgtgtattgttctattgtaatagttctaatgacattataagtgtcggaaatgtggtaaaaaatacaaccatactgactgtacaaagggaataattatgcatttctccgttctatatagtagtggagggggagaaatgaaaaagttattaaaatatttggccgccgcaggcctgataatagtattggttatggcggtttgttatatccgtctgcctgattacagaatttataaagtattctcccatagcgggtcggatttcagggaagcggacctgtatgttatcgtatataaaccatggcatatcgaacaaaaggttcagggcattgtttcacggcacaatgagatgaatggaacgcctgataaattgaccatatggctctattacagtaaatatggtctggaccggggaaagaatttttataaggtgatatttgagtatcataaaagccaggtgacggagccgcccggggcatggtagggaacggggattggttgattgtaaggaaatgatattggccagagcatgaaaattgtttggaaaatatatgtgacaataatcgaataaagtcaattattgtaaaaaaattaaaactttattgttaaaaaaatagtaaatatgttaaaagacaaactattgttctaagttatcgcgattagtgctatgatgataaaataaaatagtgaaggaggtttagcagatgaaaataacagcagcagttgtgagagagaaaggtaagcccttccagtttgaggaattggacctacagaatccccgcgagggagaggtgatggttaaaatagcagccagcggagtatgccacacggatgaggtggcccagcatcagatgattccagtaccccttccggctgtcctgggccatgagggatgcggtattgttgaaaaggtgggagagggggtaacggaattcgagaagggggaccatgtggtattttccttcggatactgcgggcactgcaggaactgcctggcgggaagaccctatgcctgtgagaatttcaatgccattaattttgggggtgttatgagtgacggcactaaacggctgtcaaaggatggccaggagatttcttcctttttcggacagtcctcctttgcaacctattctgttgttcataaaaacagcattatcaaagtggataaggacttggaactggatatcctggggccattggggtgcggaatacagacaggcgcaggcgctgtcctgaaccggcttaaaccggctgccgggtcaagccttgtggtgtttggctgcggtactgtgggtatgagcgcaattatggcggctcatttatgcccttgtaaaaatattattgctgtgggcggaaatgaagagagccttgctctggcgaaagaactgggagccacccataccattaaccggaagaaatgtgactgcattgttagtgaaatcaagaaaattacagaaggcggcgctgattatgccattgataccagcggtgtgcccgattttgtgaaaaaggcattggcctgtgttaaattcctgggaacagctgtggtattaggcgttacaggagaactgaccatacaggttcaggaggagcttatgggtgagggaaagtccctcataggcattgtggagggggattccaatccgaagctctttattccgcagttgatttcatactataaacagggaaggttcccctttgacagattgattcgcgtgtttgagtttgatgagattaatgaggcatttgaggcatcccacagcgggaaagccatcaaagccctgctgaagatgagatagaggaggcgttgagaatggagtatcaattatacatagacggggaatggaaggaaactgtgacaggttatgtggctgaggacaagaatcctgcggatgattctgtgttcgcccgggtacactttgccggagaggcagaggtggaggcagccattgcggcggcccaaagggcatggaggccatgggccggcacacctgccgctgaaaaggagcagattctcctgaaagcagctgactggatgcagaagcatatggatgaggtggcggatgtgctgatgggagaaagcggttctgcctttggaaaagcatactttgaagcaggatttgcagtggatttattcagggcagcagcaggagaatgcaggcgggtatttggccaggtccagcagcaggcgccgggtgagatatccatgattcgaagactcccccttggggtagtggccgggattgccccctttaatttcccgttgcttttggctttgaaaaaggtggtatttgccctggcagcaggcaatacatttgttctcaagccagccagcgccacgccggtttccggtgttatgatagccagggcgctggatgcagcagggcttcccaagggagtattcaatctggttcccggttccggtgaaacagtcggaaacaggctgattgaggataaacgcgtccgtatggtggcatttaccggttccactgccgttggaaaggggattgccgccaaggcatctgtccttttcaagaagtactccctggagatgggcggcaagaatccgcttatccttttaaaggattttgacttggagcaggctgtgaggattgcaggattcggggcatttttccatcagggacagatatgtatgtgtacctccaggctgattgtggaggagcctgtatatgaccggttctgtgaaatgtttgccgcttatgccggcactatgaaggtaggggacccgcaccagcaggataccatcattggtcccctcattaagcaggagcagtgccggatgattgacagccagattcaggacgctgtttcaaagggggcagtgctgatgacaggcgggtcccatgagggcaactattatcagcccactgttcttaaggatgtgacgccggacatgaggattttctatgaagagagctttgggccggtaacttccattattaaggcaaaggatgcagaggatgctgtccgcctgtgtaatgacaatgaatatggactttcctcatccctgctgaccaatgatttatcaaaggcaatgtccctgtcccttgatatggaggctggcatggttcatattaataatgcaacggtttcagataattccacggtggcatttggcggagtgaagaacagcggcgtgggaagggaaggcggttcctattccattgatgagtttacagagctgaaatggattacggtccagtatacaccggcgcagctgccattctgacaacaggcagaggagggaatacgtttgatggagtaatgcctcagccctttgcgtgcctggaaaaataggctgtcaataccctgaggctttcgtctctcaggacgcctgctgtaacctggggtttccagggggagtgctcaaagacgattttacagcattcagcgccgttctcatgaagtatgccgcataaatcaatatcgctggcgccgtagaccagccggcccagcttagtccataccattgcgccgcagcacataaagcagggttcgcagctggaatagagggtgtattcctgcaaatccgtgatatgcgtctcagcgcaaaaacggcggagtaagccggcctctgcgtggaaggttgggtcaaaaccagtgtaaatctggttctcgttgctgtacacaatttcaccgtctttcaccagcacggctccgaagggttcgttcccatggctgacagccagttgggacaggcggatagcctctttcataaatattgtatggtccatcatttggttcctcctggtttaattgatttaactgataatatgtttatatgtattccgggttttcccggcatgtaacgcggtagcgtatccggcttattccggcacaggcaggttaatggagatagtccgcaagcacaagaaaaaggtaaacagccaggccggccagcgcagacagtccaatgaacatcaggtatccgtatctggcatttttgtcctcgccgggacaatagaaaattcttccgtcatttggattgtaataaatctccgcctcttcaccgggttttccggcaggaaggaaggccagcggaagccgcgagtccacccctgtgtagtgctggcccttggcgtcatagttagttttatctgtgttaatttattaaaagccatgagctatatcttataaatcatttccgtaaagccgcttattgcctgcgaggccgaagttctagcctctgagcctcctgcttaagaattccatggctggctggacaataccctccatgagcggaataagattcggttccggaaagaaaatatgctgcagccgtaattatggttctgtgggctttctggctgcgctttaggagatgcgctgttttcgtgcgatatttcgtgtgatatcgtgggatatatttgtatattccatacccatataaggatattacaacaatttcagacaatcaaaaacccacgcaattacgtagtttctcgcaattatgtgggtttaaaaatagtggagacaacgggattcgaacccgcggtctctgcgttgcgaacgcagcgctctcccagctgagctatgtccccattgattcgattatagcacggttgggaaaaaatacaagttaagtttcggactttttacatatttttcttcttttcagggcatactgttgccagagatgattgagccgcgcggacaggcggcggaagggagacggatatggacaggtatgaagaagaaaagcaggccaggaaaaagtcaaatgagatgtttaacagtattacagaaaaggtgaagccggaaaaccagaaccagacccataactccagacgggaaggaatgggaccaaatacaaagaggaaaccatgttaagcatccatgcgggtgcttttctttttgacttttttgacggacatgcggacgaatctttgaacgcctgaggttatccacaatgttgtggaaaagattgtggataatatgttattatctgataaattgaatgaaaaagagactgtgacagacagagatatgtcctgcctgtacacagtccctgaggatggaattactgagccttatttacaaaagactcgcagtctgtacattccttcttggttgggttcatttcgtgagttccgaccttgatggcgtccagggtacagtaatcctcagactgtgcattgtaagcacagttcttgatggtacatttgatgctctcattttttccatttactttcatggtaaagcctccttttaaattgaattggattcaggtttattatttgcagaaaaacagaaaaaatacccccaatatgcaggcgaaataaaaactgcggtttagaatttaagggaaatgccttatattttaggaggataaggctgtataaaataaaatatgtttgaaaaatcttatgttttgttatatactaaggtctatgggcggccatggacaggcagcggagcggtccggcagacaggatgaggcatggcgcccgggacaggaagcccctggaacataaataatacaaaaaggatggttttactatggcactgttagagacatggagaaatctggcttacggcgacggcctggatgataaaaagaaagaagaattgtgggctggatattttcagattgagaagggaatctatgagcagattctctctaacccaacagaggttatcacaggcactgtaaaggacctggcagagaagtacaatacggaaatccttatcatgaccggtttcctggatggaatcaatgagagcctgaagggttatgagaaccccattgaaaccatggaagaggacacagaggttaagattgagattgacccggagaagctgtactacaatatggtagaggcaaaggctaactggctgtatgagcttccccagtgggatgagctcctcacaccggataagcgcaaggaactgtacaaggcccagaaggcttccggtacagtgcgcaagggcaaaaagattttcccaaatgacccctgtccatgcggaagcggcaagaaatataagaagtgctgcggaaagaacgcataaagcccaggattttacccgcctgcccggaactgttccggacaggcgcttttgtagttgaatgattcagtgatggcgcgggaatgagacgcagcgctgccgggaaggatgaagacatggaagcttacagcagttttgcagaggtctacgacatttttcaggacaatgtaccctatgaggcgtggtgttcctatgtcaccgggctgttgcgggagcagggggtggagaacggcctggtgctggacctgggctgcggtacgggcagccttaccgggcttctggcaaaggccgggtacgatatgataggaattgataattccggggaaatgcttcagatggccatggataagcgggcggcctcgggacaggatattctctatctcctgcaggacatgcgggaatttgagctttacggtacggtgcgggcagttgtcagcatatgtgattccatgaattatatcatggagcaccaggatttggtgcaggtattccggctggtgaataattatctggacccagggggagtatttgtttttgacctgaatacagagtataagtaccgggaattgctggcggataatacctttgcagaggccagggaggagagcagttttatctgggacaatttctacgacgaagaaaccaggataaatgagtatgacctgacactgtttatacgcgagggtgagctgtaccgcaagtatgaggaaacccatttccagaaagcctacagcctggaggaggtaaggcaggcagcggaggaggcaggcatggagtttgttgctgcttacgatgcctgcacccgtaatccggtacgggaggacagtgaacgcatctatatcatcatgagggaacagggcaagacaatcagagacgaggagtgaattgtatggcagattatgtaatcagagcaactgcggcagaagggcaaatcagggcctttgccgctacaaccagggacctggtggaacaggccaggatatcccataacaccagcccggtggcaacggccgccctgggcaggctgctgaccgccggggtgatgatgggctgtgacatgaagggggaaaatgacctgctcacccttaagatacagggggacggtcccattggcgggctgaccgttacagcggattccaggggcaatgtaaagggatatgcatttaatcccatggtaatgcttcctcccaatgaaaagggaaagctggatgtgggcggagcgctgggcgtaggtgtattaagcgtcatcaaggacatcgggcttaaggagccgtatgtggggcagactattctggtgacaggagagattgcggaggacctgacatattattacgccacctcggaacagacaccgtcctccgtggcgctgggtgtgctgatgaataaggataacacggtgcgccagtccggcggattcatcatccagctgatgccgggggcttccgaggatatcataggcagattggagaacaagctgaaggagatatcctccatcaccacattgctggatgtggggaacacaccggagatgatactggaatatgtgctgggcgaattcggcctggaaatcagcggaaggctgccggctgtattttactgcaactgtacgaaggaacgggtggaaaaggcgttaatcagcgtgggcagaaaagatatcggggaaatgatagaggatggcaagcccattgaagtgaactgtcatttttgtaataagaattatacgttttccgtggaagaacttaaggacatgctggaaaaggccagatagggcaggatatatcacagagccgctgcaaagcagcatagaggtacaaattattaaaatataaggacataacaataaaagccagtcgcaggactggcttttacttgtaatcatttgaaatcagatataacttacttcaacctctatcagtgatgatatatgtttgaaaaaggtacactgttgttcattgattataatttggttacgtttgtagcctgaggacccttagctccgtttactacatcgaactcaacttctgcgccctcatctaaggacttgaagccatccatgttcagacctgagtagtgaacgaatacatcgtttccctgctcgtcggaaataaatccgtaacccttctggttgttgaaccacttaactgtacctttcattacgatacctccaaaaaatataaaaaatagaaaaatgtgatatgttgcaagcaatttcgcaactgtcctaaggatatcataaatgttgaaaagtgtcaaacgtttttggtcattaagtataaacaatttatataaacctcagattctgttgttcaaaggttaaaatataaagaaatacaggcagaaaggtgaattttatgatatactatagcatatttcaatgcagtacagcatgcatattattgtgtaaagaagggatttgaatgaaaatctgtaatatatggaaccatttttgtaccatcaccaggcacaggaacctggtcaggaagcattgctttcagattggtctgtactggcagggtctgacccatgacctctccaagtacagcccggaagaattctggaccggggttaggtactaccagggagaccgcagccccaatgcggctgagcgggagacggtaggatattccagggcctggctccaccacaagggcaggaataaacaccattatgagtattggatagacatatccaaccacaaggaagagggactggtgggcaataagatgccgctgcgctatgtggctgagatggtctgcgaccggattgctgcctgcgaggtatataagggcaaggcttataccagcgccgccccgctggagtattacgagtatacaaagaattacatcaccgtccatccccggaccagggcgctgttggagaagcttctccatatgctgaaggaccagggggaggaagctacctttgcgtatctgcggaaacttttgaaaaagggaacgtattagggatatttgggataaggatagaaaaggaaacaggacattgcagaggccgccttctgtctggttgtataccggaggaaggcggctttttgtacatgctggtggtctgtttgaaattgaacgtctgtctggaattgaacgtctgtctgagatgaggcggaatatcctcagcccggctgcgccggaaataggtcagcccggccgcctggaaaacagccgtcccaggaacaggtggcatataaagccgcccaggaccatggctgccaggtacagaagatttccggcggccgtaccgatggtgagggctatctggtggaagacaatctgcccgtttggataatagggactgatataaaacatatctgcgttgccgtaaggatgggaagcaacattgatgagcgtggccatgcacacgcaggccaggaacaggggaagcatggatgcaaaatcgccgggagtcctgcctcccaggccggtcatggcgcagtacagtccgatgaaaatgagcatgaaatgccacagaaacccatggagggtcaaaagcagataggggtgcatgagaccgctgggttccgccagggccatgacgccgcccaaaagggcaaaatcctgcatgaaggtgcatatgcatttttccgcacggcgatggcggggatgtctgaacaggggaagaaccaggcacagatacatgggcacgctgcagagctggaagggaaaaaaccaccagttgtattggccctggctgacgataaaatataggaagccctgcttatacagttcactggcagctaaaaacaggccgcagatgaacagcacacgatgagggtgcaggtgtctgaatgacagccgccgggccagataaacggcaaacggtatgcctgcagcgcagagcagaatgtgaaaggcagaatatggttcaggcgcctggataggccatgcggcagcctgtagtaatgtttttatgaatgatagcatagctgtgcctcctgacggaacgattatacatcatatgcgggaagaataccagaataaaatagaaacctgcgggaatgctaagataacggtaaaattagtggaaaggcaggaaaataatacatgggatttatcatagcattgctgtcaggcgccttaatgagcatacagggcgtatttaacacggaagtgacaaagcagaccagcgtctgggtggccgctggctgggtacagcttacggccttcatcacctgtgtggttatatggatgtttacaggcagggagccagtggccggcattatacaggtgacgcccaaatatgtgcttgtgggcggtatcatgggagcccttatcacttacacagtcatccggagcatgggaagcctgggaccggccaaggcagcccttctgattgtggtgtcgcagattattattgcgtacgccatcgaactgtttggactgttcggcgtggagaaggcgccctttgcatggaataagatgattggggcagccattgccataggcggaattgtgatttttgaaagataaaatttggaaatttatgcttgtatttgcagggggtttccgatagaataggagtatcaggctgggacggtgctctctggaaggagggataccgcccaagatgaaacttacatctttcaaagcaatgaaactggcagtgattgtcatatgtatgttggctgcaggcatatgctatagctgcagtgtgaagaaccgggacagtgggccggataacatggtcatggcattggagcctgacagtggtcctgctgccggggaatacgcgggcattgaaagcccgcagtacatggatgggcccgaaggcggggatgacgctttatccgccggtgcggatggagaacatttgccggggcaggaagatatacctctggtgtatatccacgtatgcggcctggtgtgtacgccgggcgtgtacggtctgcccgcaggcagccgggtatatgaggccattgaggcagcgggaggattctcagaagcagcggcgccggattatctgaatctggcccaggagttggaggacggcatgaagatacaggtgccggaccgtgaacaggcagaggaatggaaggcccaggggctgaaccagcccggcgtgtccgcaggcggtatgccggccggcgttttggtgtccggcagcgcagggaatggcaatggcggctctaaagccaggataaatcttaacacggcttccagggaggaactgatgaccctgagaggaatcggggaatccagggcagaggacatcatacattaccgcgaagaattcggcggatttaagtccattgaggatatcatgaatgtatccggcatcaaggatgctgcatttgagaagattaaggacagtattacagtgtaaatgacggcaggcggccttggttatcaggccgccgtttaataatagataaggggaatggaacatggcaagagtattagtggttgacgatgaaaaattaattgtgaagggaatccgcttcagcctggaacaggacgggatggaagtggactgtgcatatgacggcgaggaggccatagaactggcaaaaaagacagagtacgatatcgtgcttctggacgtgatgctgcccaagtacgacggctatgaggtgtgccaggccatacgtgaattttcagatatgcctattattatgctgacggccaagggcggcgacatggataagattctgggactggaatacggcgctgatgattatatcagcaagcccttcaacatattggaggtcaaggccagaatcaaggccattatacggagaagctccaagagcaaacgtcagaagcgggaggagcctgagtccggcgtcattggcgcaggggaccttaagatggacacagagagccgcagggtgtttatcggcgaacgggaaatcaatctcacggccaaggaattcgacctgctggagctgctggtgcgcaaccccaataaggtatacagcagggaggcccttctgacctatgtgtggggaaataaggccatggacagcggagatgtgcgtaccgtggatgtccatgtgagaagactgcgtgagaaaatcgaacccagtcccagcgacccaaggtatgtacatacgaagtggggcgttggatactatttcagggtaaaggcataaggactgcgaaggacacgaaaagaggacagaagatggatggtattaccataaggacagcggtaccggctgatttggatgcagtggtacaggtggaggcagcctgctttccggcagcagaggcagcagacaggaaaagtctgaaggagcggctggatgcatttccccagagtttttttgtggcggaggacggaaacagaatcattgggttcatcaatggcgctgtcacaaatgagagaaccattggggacgagatgtttgaggatatctcgctccatgagccggagggggcctatcagagcatattcggcctggatgtggttgaggaataccggcaccggggcgttgcttcccgtctgatgaaggccatgattgaacaggccaggaaccagggccgcagggggctgatacttacctgtaaggacagactgattggctactatgaaacgttcggctatgtgaatacgggtctttccaaatccgttcacggcggagctgtgtggtacgatatgatactggagttttaacagatgaagattacccttgttacggttggaaagattaaggaacggtattttgaggatgctatcagggagtatgccaagcgcctgagccgctactgcaggctggacatcatccaggtggcggatgagaagacgccggacggggccggtgaggccattgagaggcaaatcaaggaaaaggaaggacagcgcatcctttctaacataaaagacggggcttacgtcattgccctggccattgaagggaagatgctggccagcgaggaactggccggccggattcaaaggctgggagtggatggcataggccatattgtgtttgtcataggaggttctctgggcctgtcggaggacgttatgaagcgggcggactatgccctgagtttttctaagatgacatttcctcatcagctgatgcgtgtggtgcttttggagcagatttacaggagttacaggattatttccggggaaccgtatcacaagtagcggggagaaggatgattgtgagaattaggaatggtggccttgatttaggggagtgaatatcttataattagggtaggaagtaacgttgtggatgtacttatgagatgaaacaagctaaaattacacaggagaaatacatgggaaatataaaaacagattgggatgaactgggcatatcaaatgatttcctgtttggaaagattatgaggaatccagagctgtgcaaggaactgctgcaaagaatcctgccggagttggagatagaccgtatcgaatacccggagacacaaaaaagcataaagccggatgtggacgccagaagcgtgagactggatgtatatgtgtaggatggtaaaaatacagtctatgatatagaaatgcgggtggcggatacaaaagaactgccaaagagaagcagatactatcagagcatgattgatttacagttgattgataaagggcagtcttataaaaagctgaatcagagttatattatatttatatgtccatttgatttgtatggaaaggggagacatatctatacatttgagaatgtgtgtaaagaagataccagcattagccttaaggatgggacaacaaagattttcctgaatgcaaagggggagatggatgatgtcagcaaggaattgaaggcatttctggattatgcagtaggtaggaagtcggatgatgtctttgtaaggaaactggaggaagcagtagaggaagccaagcggaatcgagaatggaggcatgaatatatgacgttgttaatgcgtgaccaggagaatgtggaaaaaggtaagatttatggtgcaattacaacttatagagaactggatttatctgaagatgagatattaaagaagttagagataagatttcagttaacagagaaagaagcaaacgagtatttgcagaatgcagagtaagtttgcattagaagaaattagtattgtaagagaaatgaaaacaagcagttattataaatataataagggaatcccaggctgataattatagttggcctgggatttttttgtggaaaggaggatagaggaaatttgataatcatcaagaagggacgtgatataggaatgaatttctaatttcaaaataatctgaggaggataccaacgtggaaaaagatttaaaaatgtacatagcagatgagttcatgaagctgaatacagtagaggaacagagagaattcattgaaaatctgcgctttcttatgatggcggatgataatgatgatattattaatttcttgtcagagaaggaggatgtaccccaaaagggtatgtcctctattttaaagcccaatactatcaatattgaattttgtatttaaaaatagggtgaaatggcatacagtggatttggggagatagaagtttatcctacggtggaagaaaaagccgccaggattgctttaggattaggcgtggcagatggcagtattggttatgatgaaatattagattggattataagtcataaaataatggaatagaattaagaataagcagatattataaacatagtaagggaatcctgggttgacgattatagttggcctgggatttttggtatgggatttttttgtgataaggacatcctgtatgattggcagaatgagataatggaattcatggaaaaaattcccaatagttaccaatgcgttacaattaagtggacgattttgcagataagtgttaaaatgaaacaaaaaagggggaatgtacatatgagaaaaccgttgctggtaattttatcagtagtattgattttagggggctgcggaggttcaggaacaaccgctgcaacgggtgcggagaaggaacaggcgactgtggctgaggcagcagacgcagcgcccaaggaaaccacacaaaaggagaccacagaggctgaaaccacagtgcctccaaaggaggtaaaggaactgtctgtgagtgaatttgatgagctgctggccggtctgccggtttctgttgtaaagacggaatacattgtgcaggatgaacagtataagtcgctgtatccggatatgctgggtacggtcattcagaataatacggattcagacattaaagatgcggttcttgccattgttgcctgggacagcaaccagcttcctgttaagctggagggcaacatggacttttcaggaggagattattttaagaaggtaaactacaacgacatcaatctggtgggcgggagtacatttggtgagaactcgggcttttccatcaatgagtcctgcaaggtagaatcttttaaaacaatgatactgtcatttgaaacgtttgacggtgataaatggaggaatccatatgaggacagcttccgggcggcctatgaggggaagaagtattccgatgatataaaaattgaggtcgagatgcaggacgctgcttttacgaagtccgggaccgcgtcgggaacaaaggtggaaagcgctgactctgaagaactggaggcatccctggccgggcagcccgtgtttgtgagcagcacaaagtacgtggtccaggatgagcggtataagtcgctgtatccggatatgctccaggccgtgattcagaataattcagaggatgatatccgcgatgcggtggtggcctttgctgcctgggacgccaatggccttcctgtaaaaatcaagggtcagatgagctttaacgacccggcctatgtgacggaagtttcatttgaaaatattaatctggttcccggcagctcctacggtgattcccaggggtatgccattgatgaaacctgcggcgttgaatcgttcaaagcaatcgtggtgtcatacactgactttgaggaaaaaacatgggaaaatccggattataaagcattctgcgatttatatgccggtaaacggctggcgcagtgatgaagtccgggccggaagtcccggtaaaaccaaaactataaaatattgcccttttgcactatcaatatcttgcggccatgtcttatttcttataggacatggcccattttttgtagttcaatttaaagcggaaacgcttataatcatcctgtaaagaaaacgttaagattcccggagggaagaacaggagaacatgattatgatgaaaaaggcattaacactgatattggccggggcagccgcattgtcactgaccgcatgctcaggaggcgcgtccccatccgccgccacagccccggcgccggcagcaggcggggagtccaaggccgacgcgtctgaggcagtcaaaaaggacgcaaagacaaccacactaaagctggcttttaaccagtcggagaagcatccccagtatctggccctgtccgagatgagcgatgccttctacgagaaaaccggcggcgcatatagaattgaaatcagccccaatgagcttcttggttcacagaaggatgcatttgagctggtacagagcggtaccatccagatggcaatggtagcaaactccattgtggagaatgtgaatcctgattttgccgtattaggccttccttacgcctatgacagtgtggagcatcagaaaaaggtatttaccagcggagctctggaccatatctttgcaagcacagaggccaataatttcagcgttatggctgcatttacagcaggagcgcgctgtatctatacagacaagccggttcagaccccggcagatttaaagggctacaaaatccgcgtcatggaatcacagacctgtattgccatgctggatgcaatgggcggtgtgggaacgcctatggcccagggcgaggtttacactgcaattcagcagggcgtaatcaacggcggcgagaacaatgagattacatatgcagatttaaagcactatgaagtggctccttacttttcctacacacgtcatctgatgattcccgaccttttggttatgaacacagcggccttaaagggaatgagcgaagaggaccagcagaccttaaaggacctttgcaaggaatatacagagcgtgaattccagctttgggatgaaaacctggaaggcgcaaagaagacagcagaggaagcaggcgcccagtttattgatgtggacatcactccgttccaggaagcatgccagtccgttatcgacaatgtgacaagcaagagcgagggagcaaagacattatacgaagaaattcgcagccttgccaactaacagggatttgcagaaagcggggtcatgactcatggaatcagcaaagagaatcctggacaggataattgagtgggtatgcgtggtgctgctggctgtcatgacaatcctggtcaccttccaggttgttgtgagatacttctttaacagccccaacgcatatacggaatcactttccaaatatatgtttgtctggatggttatgtatggttcagcctatgtgtttgggctgagggagcatatgaatatcggctttgtccgcgaccatatgcctccaaagacaagagtggcggttgaaatgctgggtgaactgatggttgcgttatttgcggcaggcgtcatgatattcgggggctataagcaggtttcaagccaaatgattcagatggatgcggcactccagattcccatgggaatcatctattcagcagtgcctgtaagcgcgtgtttcatcctcttctactttgtctacaatgaaataaagctggcggaaaaactgaaagaaatccaagaacaaaggagatagaattatggaacaggcaatgattgtagcactggttatgctggtctgcgtactggccatgctggttttgggaattcccatcagcatcagcattggtctggcctccaccatcgccatgctgttcgtgcttccctttgagaatgccatggggacagcggcacagaaggtatttacaggcgtgaattccttctccctgctggcaataccctttttcatactggcgggaaatattatgaataacggcggtatcgccatacggctggtgaactgcgcaaaaattttaagcggcaggatgccgggggccctggcggagaccaatgtggttgccaatatgctgttcggcgccatcagcggctcaggtgtggccgcagccgcagccatcggcggaaccatcggacctctggaggaaaaagagggttatgcaaaggattacatggcagctgttaatattgcatctgctcccacaggaatgctgattcctcccagcaataccctgattgtgtactccacggtggcaggcagcgtgtcaatctctgcgctgttcatggcagggtaccttccgggccttttgtggggaatcggcgtaatggtgattgcgggaatcatggcctccggacgcggctacagaaaccgggatgaaatcaacctcaccattgtgttaaaaaccgtatgggaagccatacccagcctgcttctgattgtgattgtcattggcggtattctcataggggcttttacggccacggaaggctctgccattgctgtggtatattccctgctgttaagctttatctaccgcagcattaagataagggatttaaggaagattctgctggacagcgttaagatgactgccattgtaatcttcatgataggcgtatcctccatcatgagctggattatgagctttaccaatatcccggccattattgcggatgtgctcatgggactgaccaacagcaagattgtgattcttctgattatgaacctgctgcttctggtggtgggaaccttcatggacccaactccggcaatccttatatttacgcctatttttctgcccatttgcaccagctttggaatgcatccaatccatttcggaatcatgattgtatttaacctttgcattggtacaatcacaccgccggtaggacccattctgtttaccggctgcaaggtggcgaatgtaaaaatcgaggaagtatttaagacccttcttccatattttgcggtgacagcggtcatactgttactggtgacctatgtgccggccatttccatgaccatccccaatgcactgggactggtaaaataaaatccaatcatatcccaaatccctcagcttaggttgagggtatttggtgttgtggaaaggagggagttatgatacaatgtccgcaaaattcattttcccagaaaggaaagcctcacgtgactctgaacgttcatgcgcctgttgcggcgaatttgaaaaccgtcctgataacagccctgtcagcagcgctcatggcagtgtccgtccttgctgccggctgcgcacctgctgcaggacatgataatccggcaggcccccggagccaggccgtaatcctcaggatggcggaaaccatgcctgagaatcatccctccgcccgggccatggctcattttgcagaaatggtgagccgggaaacccagggccgggtaacggttaaaatttattataacagcagcctgggaacccccacggaaatcattgaacaggttaaattcggcggtattgccatggcccgcgtcaatgtcctggagctgtcggaggaagtggaatccatccgtaaattctttgttccctccaactttgcggacggggatgcccagtcagggtggatacacaacaatgaggagacgctgagggatgagtgccagatggaccgcatcacgcctctggtatggtattatccagatttcaggtgcttttatggtacggacagcagctttgcggacaaaaaagatttgcagggaaagaaaattgagagcagcgattccgctcttatggcggaaatattccgggacatgggaatcgagctggcaggctcggtcaataccaacacctacaaatcgctgatatcaggcaatatcgacggtgcggagtcctcgttttctgagtttatatgcaataactatgaccagtatatccattttgtcaccaaaaacgacgcatggtgccttccggatgtaatgattattaatacggaaaaccttacctccctgtccaaggaagaccgggaggccgtggaaacctgtgctaaaagcacgtaccagtaccagaaacaggccatggaacaattccagcagatatgggtggaaacgcttacggaggagccggaggtcagcttcagcgaaggagcgtttaaatgaaaaaactaaaattctggtggaaacagttcagcttttcagtgggagctcaaatcaatggagtgctgctgcttatgctgatactgttcctttcattttccatctacaaccattccctgttcagccagtttagcgccagatatcagaaggaaatcaaccagtattactccatactggagctgaaaagccatttcctccagagcggcgttctgtttggggaatacatgaagacaggaaaccggaccactctggcggagtttaatgatacctatgaaaaagccagggcggtcatagacattttgtatacagaaagtaccaatgaggaatcctggtatcttctgcggggcattgaccagtcctttgagtcttattacagtgagtgctgcaatgcctcctttctgtttaacggcaatgattaccggtactacgacagctactactacagccagaccatcggcgggtatctggagaaatatacaaatgaactgctccagtacgccctggaatccagcgtggacagcaaccgggagctgacccacaggcggaatgtaatgactgtgttcaacatgggagccgtggcagcggccggcatactcatagccgcatcggccagctacattttcgtgagggtgacccggcccttaaacgagctgaaaaaacaggtggaggagatagccaggggtaatctggacgtgcatgtcagggagagctccggggaaaataccgtgagcatgctgtcgcgggcatttaaccatatggccttcagcctgaaggaaaaaatagagagcgaaaagcagcttctggtggaacagaggaaaaatgaggaatatgaaaagctgctgagccaggcccgcttccttgcgctgcaaagccagattaaccctcattttctattcaataccctgaacagcatcaacaggaccgttatgctgggacgccaggaacaggcgctgaccatgctggattcactggcagtgctgctgcgctataacctggcggatgcgcaggcaccggctctcctgggcgaggagctggggattacggaggaatatctgaagattcagaaaatgcgtttttcatccagactgaatgtggacatcaggcatgaccgggggttggagcaggcagtgatgcttccgcggtttaccctgcagccccttgtggaaaatgcggttatccacggtctggagccaaaggaagaagggggagccctgattctggatgtcaggaaggcaggggcctatatacggatacgaatctgtgacaacggaatgggaatggaaagggaacgtctggagaaaatcagaagacgtctttcggagcatcagtcggagcggattggaatctggaatatatggcagaggctttccctgtatacgggcagggatgacagccttaaaatcatgagcaaaaaaggtgcaggtaccattgtcagtatttatctgcacaggggagaagagaatgtataaaatattaattgcagatgatgaggaactggagagggaggccctgcgctttttcatagatgagtcctccctggatatagaccaggtcatagagtgcgcctcgggaaccgaggtcattaaacgggttatgcttgaccggccggatattatggtgcttgacatcaatatgcccggcctgaacgggctccaggccctggagaaaatcaaatgcctggattacaggttccgggctgtattctccacggcctatgattattttgaatatgcagtggaggccctgcgcctgggagcagtggattttatggtaaagcctgtgaaaaaggaggcgtttatcaatgtaattatgcgggctgttgacgagttggatgcggaggcggagaaggagtaccgtgagacaaagcttctgaagaccctggacatgatggagggcaaggtggtgggcgacctggtgctgggcaatatgccggaggaggtgctttactatctggatttaaaacatatctcaactgagtgcagcggaaattgtttctgcatccgtctccagggttcaccggataaatgcgcaaggcagaacctgtttaaggctgtcaggaaagagtttggttatctggacctgacagtcatgttcagcgaggcaaaccacatggttacagccattgttttttgccgtgaaccggaggcgtttccgggaattttcgggaagatggaggaattactggcctctgttttaaggcagcagcagacagtcttcataatgggaagcgggactccctttacggatgtcagccagatagaggagagctatgggatggcccgcgaaagggtgggggacatggctgcccggactgagagcagggaggagggaccggaatcagacagcggcacgcccagggaggtggagggaatctgttcctttatacaggaaaattaccggaagcgcctgaccctggacatcattgcgtcggaggcagggttcagcaaatactatgtgaaccgtcttttcaagcaatatatgggtaccacggtggtggattacctgattcgaatcaggatgcagaaggcaaaggaactgctgaaaaacgaaacctgcagcatcaagcagataagcggattggtgggatattcggagccaaactactttacatggacattcaagaaaatggaaggtatgtctccgctgaagttccggtatgaacaggcggaggggctcagggaggagaaggacggggaatgagaaaaaagtacagggcatgggttctggcggcgctgctggcgggtctggtgtttggaggatgcggcgtgctgggggaaccggataaggggaagacgtcggcagggacagaccggcaggcaggcacagagcaggcgccggtcccgggacatccggtaagcggagcagatatttcagggaaggatgttccggcaaacaagcccgaaaagatatattccatgcaaataggccattcccagccggtggacaacccgcgccaccagtcctttctgctgtttaagaagcagctggaggaaaaaacaggcggcggaatccaggtggatatctatccggccggccagctgggcagcgaggcttccatgctggaacaggtctgcggcggaaccatccaggggtttcgcgggggacagctggagatagtgccaaagatgcttgtgttctcccttccgtttctctgtgaaaacagaaccgaggcagaacggctggtaaactctgagtttgcaagggaaatcagtttggattcaaaaaaaagcggcgccaccattttgggaatcggcgatgcagggggattccggcagttttccaacagcatacggatgattcgccggccggaggatttaaaggggcttaggatgcgctccaacggcatggataccatcaataaaaccctggaggccctgggggccgaagtcatgaccgtgccttacaacgacctgtatatggctttgaaggcaggcgctgtagacggtcaggaaaatccctgggtcaattcctcgggcatgcggttttatgaggtccagaagtatttcacggaagtgaattaccagttccacccggagcctttttatgtgaataccagctggtatgagtcgctgcctcaggagtaccaggaaattctggcggaatgtacggcagaaatgatgaaggaaaacagccgccttattgatgaaaaccaagtgcaggcaatggaaaatatccgggccaacgctgaaatccacaccctttccagggaagaacggcaggcttttgtggaggccacgcagaccgtgtatcaggaatacatggacagcgggcttctgaccatggatgagctggcccggatgaagcgcattatcagaggagaggagaagtagcgatacctgtcaagaccatggcctttatgggttattggacaggaatatagatgtcaatctggctgccgggatggtgaaacccaagaaagcgctggtcatacagctcaaagtcatccctggcgtccagcttttcctgggtggtaagggaccaggtgccccagatatactggtaggtcagaggcaggctttttaaggagcctgtgtgggtgaatacggcatactttccgccgggaatggtccggtacacaaggggcggaggcaggacggacctggagctgacctccacggacaccacctcggaaaacagcagctcatgattcatggtgtacaggttattcccctcatcgcaggactggcatatgccaaagccccggccgccgggaacctggccgggaatctgggggatgagctccagaaaacgggaccagagctgtggaatctggttgtccttaagcgtggtggtgcctctcagaccagcggtgagaacagggggaatctccacaatctgagggcggaccgtcaaggattccgtcaggtgggccagcaaatgctggtctgctttgggtttctggctgatgatgacatccagacggtttttccggtagccggccgggcttgtatggtagactgctttgaatgccctgctgaaggcttcgctggattcaaagccatggtccagcgcaatgtcaatgatgcgtctctccgtgtacaccagttccctggcggcatcggacagccggcgctttttcacatagctgccaacgctctccccaaggacggcggagaactggcggtttaagtgataataggaatatccggccgccctggcggcatcctccacggtgaaggatgcggtcagatggtcttctatgaatagaatggctctttcgattgccgtattgtagttcatatgaggctcctgtaagcaaagatggatgggtctgctgtccggtcctgtatttggatgtcagcggttccctggggaaatggactgtcgaagttgaaatcctgccagccgttttcctggcgtcctccccagcacagggaaagactgcccctgacagggtccatgaccatgctctttgtggtaccgaaaaattggctgtagtagctgcatgacaggccttttggataaggggtcagaaggaaatccttcagctgtccgtccgtgatgtcctgcccatgttgtttgaggaaagcggtaatattgtcataccggcggatggagtggacgaatgccctgggttcatggggaatcagctcatccaggaccggatggttggtggcatagagggcctgttccccggaattccggtcaatggacttcactgccatgcgtccgtccagggtttccaccagggcgcagcagccttccctgtccagcagaatcaggttcaggttatatgccaccggcatgtccctgagcatggacagggcatcttggacattgcggcagttttcaagcagggtacggaccacggcccagaactgcaggccggcggctgcgggcctgcgcatctcaggcagcgctcccacaggaaaaccgcaggagctcatggtaacggtcaggcccatctcattgattccgtcatcccggccgattcccagaacgctggtgcctatatgcgtgtattttcctgtgatgcaggtttttatgacagtaaagtcctcggcctcgtcattgaattcataattccgggccgccatgggatgtccggaggctgtcagggaaggcagaagggccaggtggctgcagcgcggcgtaagccaggtcatgccgtaatagagaacctgttccggggcgcagcccagggcatgggcaaaaccagccagctccccggtaagtcccgggcaccagcgccggaaacactggtcggcctcttcaagctgtgcagggccgaagcctgggaagccgcctgaaagctgttttttcaggccggggatggatgccagacagctgcctaagcggcggcctgcctcgtagctgcttcctgagagctctatggcctgtgtacggataagtttcatagggatacctcctcatgttgttatacccctattttaagtgaaataaaggattcatcatgatatttcctgcggaatttacgggatgcacggcccggctggtgtttatgtgtccaatatagcatacatgcggcagaaacaaaaggcatgggaagggcgtttacaggtgaaaactgctgcaggggaaacaaaaattaagtataatatagttgtgattgcaggatgatagagatataatggcagaaactacagtttgcgccggaccggcaggaaatctgcgggaagggccggcagaaaggggcgctatgaagaaaaatccccagggaaaacgctggcacaggctggataatacagggaagatatttcctatgattgccaatgaaaacctgagcaacgtattccgaatttccgtaacactgaaagaagagatagaccccggactattgggtcaggcgctggaagaggtcctgccctggtttggcgggtttaaggtaaagcttaagagagggtttttctggtattactttgaggagaacaaacgccagccctttgttgagcaggagaacagctggccctgccgttatattgaccccaagagcaaccagctctatttgttccgcgtaagctattatggcgccagaatcaatctggaggtattccatgctgtgaccgacggcatgggggccgtgaatttcctgagggagctgaccgcaggctacctggagctcaaacggggagggcggagaaccggggaacggccgggggaaggcgtgtccacccagacagaggacagctatcttaagcattaccggaaaatgcggaccaggcgttacagctcctgccctgcgctgcgcctgaccgggaggtatattccctttggaggagagagcgtggtccacggttctgtggatacaggggcactgaaggccgtcagccgcaaaatgggggtcagcattacaaagtacctgacagcctgcctgatttggtctgtttccagggaataccgggaggaaggccgggagggacgccgcatcggggtaaacctgcctatcaacctaagggcctttttcggctccaatacagcttccaacttttttgcggtgactgccattgaccacgaacccggccgcggcagggatgaatttgaggaaatccttgcatctgtgtgcagtcagatggacgagaagatagtaaaggaaaagctggaggaaaccatttcctacaatgtttcaaacgagaagaagtggtatgtccgcatccttcccctgtttgtcaagtggctggcccttggatttattttccgccgcaatgacagagcccacaccattaccttatccaatatcggcctcatatccatggaccgggaatatgaggatgatattgaagggttcaggatgctgattggcgtgtcaaaacgccagccagccaaatgcggtgtatgctcctttggaaccaggacagtcatcacctttaccaaggtatttcaggatgccaggctggaggaatgttttttcggacgcctgaggtcagacggcattccggtggagctggagagcaacggcgtcatcatgccggaggctgataagggaaattatccggtgattcaacacgatgagagtatatggaaaaaattggtattggcctgctatggggtgctggcggcagtggcgctgtttctcgggctggtgaatatcgccacctatgacgggctgtggtggtccgggattgccataccgggcattgcctatgtgggtctgacccttcggtattccattctgcgccacgctaatttaggtaaatcactgctgatagaaaccataggaatgcagattctgcttgtgatgatagaccgggttctgggatttgagggttggtccgtgaactacgcggtgccgggaaccattctgtttgccgatgtggctgtggtgctgctcattcttgtgaaccgcctgaactggcagagctactttatgtaccagattgccattacggttttcagctttattccgctgattttatgggccgcagggctggtcacccacccttccatggcaatcataaccgtgattctgaccgtgggaatcctggccatgactatttttctgggtgacaggagatttaaaaatgaactcatcagacggttccacctgtgacaatggagggaccctgcatttacagagaggatacagataaggatgcgcaataaaaaagtgagtatacggggggcgctggtgcgggatatgattcacgacatcatggaaacgtccctgggaaaacccatccagacaggggaattcaggaaaaatcccgtggaaccggcctgggtatgcccatctggctacgagtatgaaatcattgacagggaaccctttaaaatggaatatctgaagccggagggagtggttaccggcagggtggtgcttcagcttcacggaggcggatatataggacccatgaagaatatttaccgtaaattttccgtgcggtacagccgtctcagctatggaggcgacgtgctgaccgtggactacagggtggcgccggaacacgcctatcccgcggccctggaggatgtgattcatgcctatcagtggctgataaaggaaaagcattacaggccgggccaggtggtggtggccggcgattcggccggaggcggcctggccctggccctgtgcctttacctcagggaccacggactgccccagcctgccgggctggtgctcatgtccccatgggctgatttgacctgcggcggggacagctatgagtttaattttgaaaatgaccctctttttggcaattcacgggaaagtatgctttataattcagcctatattggccaggccgacccgagggagccctatatgtcgccggtgttcggcgatttccggggactgccccccatgcttcttcaggcaggcagtcatgagatgctcttaagcgatgcgctggaggtagcccaaaatgcccgcttggccggggtgaagcgccggatttctgtgtatgagggtatgttccatgtgttccagatgagtatggacctggtgcctgagagccgggaggcctgggacgaggtggcgcggttcatgcagattgtatacaaaattgacaggaggcctacggggcagattgtaaagaaggtaaagagaagaaaacggcagggaacgaattagagtgagataaaccggccattatccgttcaaacagatacagatatatccagtttggcagcacagcccttgcgggcgggtgctgccttttttccggctccagtcatatttttggacacgtctcatatattgaggtaaaaggggtgaagaatatggctggcagggaagaagttcttaaaatattcccaaaggacctgcggacaatacttggacaggttactgtggatttcgacagggtgcaggagatacggatgaggacccagaaaccgctgctgcttatctgcggcggccgggaatatgcagttaaaacagatggcagtctggcggttggggttcccgacccgccggtaagggatatacggggaagcggccgctgccaggaacaggagcggtactgggccagggccggaatcgtcacggtcagccaggctcagatgaaggaaaccgtggaatatatgtgcagtttttccctctatgcagcggaagaggagctgcggcagggattcatcaccatacagggcgggcaccggattggcgtggccggaaggaccatggctctcgggcaggatatacggctcatgaaatccatatcttttatcaatatacgggtggcccatcagattcagggctgtgccaacccggtgatggaatatctgtattcggatgacggccggtttctgaatacattggtgatatcgccgcccaggtgcggcaagacgaccctgctgcgggacatcatccgccaggtttcagacgggcccaggaccccgcgcaccggcaggagaataccgggagtgtctgtgggggtggtggatgaacgctcagaattaggggcctgctatcagggggtgcctcagaatgatttgggtatgagaaccgatgtgctggactgctgtcccaagagccagggcatgatgatgctggtaaggtccatggcgccccaggttatagctgtggatgagattggaagcagggaggatgtgcaggccatcgaatatgtgaggaactgcggctgcgccctggctgccactatccatggaagctccctggaggatatcaggcagaaaccggctgtgagggagctgattggacagggagcctttgaacggatgattctgctggactgtcagggaacagcgggccatgtggcggctatatgggatggaagaggaaacgtcctgtatggggatggaaggggaaaggagtcgcagagtggcagtatttaaatggacaggggcaattctggtgctgttttccgccggcggactgggaatctggtccgccatgcagtggaaagggcggctgaggatgctggaaaccctcagacagatgatatatttcttaaaaggtgagattacatacagccgggcgccgctggcagaagccctggaacgggtgggaaaacgggagccgggacctctgggaagcctgtttgaggctgcggcagagggaatctgtatgcaggagggagagtcccttcaggagatatggaggcgggaggtcatggccttaaagtcagacacgggccggattcctctggaacagggggatttggaacagctggcgcacctgggggaacatctgggttatctggatgtggacatgcaggaacgtacccttaagctgtatctggaacagctggatttgaccattgattatctcaggcagaaccagagggagaaatgcaggctttacacaagcctgggaatcatgggaggaatgtttcttgtgattgtgatgttctgagatttgccgggaacacatgctgtatgattgtggtgtgccggggattaacaggacagatttgtaaatatggattaaaaagattgaggagacagcaatgggtgtaaatctgatatttcgcatagcggcagtaggaatcctggtatctgtcatctgccaggtattaaagcacagcggccgggatgagcaggctttcctaacgagcctggccggactggtgctggtattattctggatgataccgtacatatacgacctgtttgagacaatgaagaatctgtttgcgctgtaagatgcgccttttcagggagggaaccatatgacaatcattaccattgcggctgccggaattgccacggtcctgctggcagtgcagctgaaggggctaaaggcggaatacgccgcatatatggtcatggcggcaggcgcctttatcttcttttacggcacgggaaagctaaaggacatactggaggccctggaacggattcagggctatatcaaggtcaacagcgtatatctggtaacgctgcttaagatggtgggcattacctatgtggctgagtttgcatccggaatctgcaaggacgctggctacggttctctgggaaaccagattgaaatattcgggaagctgtccatcctgggtatcagtatgcccatcctgctggcgctttttgggacattggagacatttttgggatgaagagatggaaaaaacggggggtcagaagcgctgccctatgtgtgctgacggtgctgcttgccggaggattcggactggcgggcagcactgcttacggcgccccggcagacgggcagctaagggggcagggtcaggtcatagcgcaggccgcggggcagggccaggaaacggagtcaggggcggaccgggctctgcaggatatggggctgcaggatgagatggaggggctgcagcagtttctggatgatgttatgggacagcaggacgggggcatggaaggactctccttctggggactgatgaaggagctgatgaaaggaaacctgaaggggattctggggcagaccggaatgggccttaagaatgcactgttctcacaggtggacaagggcggccagatgctgtttcaggtggcggccatcggcctgattggggctgtgttcaccaatgtttcctctgtatttaagggaggacagatttcagacaccggcttttttgttacatacctgcttctgtttacatgtctggccgccagtttctccgccagcttacaggtggcggcccgggtgatggagcagatactggaattcatgaagctgctgatgccggcctattatatggccgtggcattttccgggggcagcatgagcgcactggctttgtatgaatgtatgctgggcgcggtgacaggggtgcaatggctgtgcagcacggtcctgctctccatggtcagaatttatgtgctcatggtgctgggcagccatgtggcgaaggaggcgcttctgtcaaagctgacagagcttttggagcaggccgtggtgtggagtctcaggaccctgaccgggctggtggtgggcttccatctcatacaggccatgatacttccctatgccgatgcagcaggccaggcgggaatgaaacgtcttatggaaatgattccggggctgggccagggggccggcgccatggctcagatggtcctggggtcaggggtactgattaagaataccatgggggcggcagccgtggttgtattggctgtaatatccgttgtcccggtgatgaaactgacggtcctcatgattatgtaccagtgcgtggccgccgtgatgcagcccgtgtgtgacaaacgggtggtgtcctgcgtgtcaggcgtgtccagaggccataagctgctgctgcagattgtgctgtactccatgtttctgttcatgatagccatagccattacatgtgcgtccaccaatgtgaattattttgcctcataggagaacggacgaagcctggcaggggagcgggacggggcttaaccggggagcggacggagcctggaggcggatgataaaataccggaatagcgttctataaaaggagatgccgatggaagctgtctatggatgggtaaaaaatatcatatactacatgattttcctttcagtggtcaataaccttctggcggactctaaatacggcaaatacatccgctttttttcgggaatggtcctgattcttcttgtggtaagtccgtttacgggaggactgcacctggatgagcagatatcagccatgttccgttccattacctttcagaacgacacggacgacctgaaacaggacctgtggggaatggaagaacggcgtctggaccaggttatcagcaggtatgaggaggcggtggcggctgatgtggaggccatggccagggaggagggtctggaatgtaccggggccagcgtgcagattgacggcgaccgcaacagcagccgttacggccggattgaaggaatcaggctggttatcagcggcgggaaggaggaaccggaacagggcagctgggattatatgggcagccggccggtgaatgtggatgcggggaaggtggacagcgtgaaggttgaggatgtggaactggggaaaacgccgggaaccggagaaacagaggaatctgaaacggcggcagataaaaaaataaaccatttaacaggaaaggtggcgcagtactatgggctggaagaatcagatatcaaagttcagtggaaaaatgactaaggaaaaatggctgttattgcttctcataggtgttcttctcatgattctatcctttcccctgcccggaggaagtaaaaaggacaggaatgccggtgaacagaccgtgggtaccgggacagagggggccggggctgttccgctgtggacaaaggacaatgccaatggcggcagcggggccggcggctctgtccagggcgccgccggaaccggcatggcccaggggccggagggtagcggggcaggcgcatcggacgggacggaggattcctatcctgcagcggcccgctcatccgatgaagggtcctatgaagcgcagatggaaaacagaatcaggaatatcttaaagtccgtggacggcgtgggtaaggtggatgtgatggtggtgcttaaatcctccagtgaaaaggtgctccgcgtggaccgttccaccaataccagcaccacccgggaaaaggattccgggggaggaaccagagacgtgacgaacaatcagatgcaggagagcaccatactgtcgggaagcggttccggcagcagcggaaacgcgcccattgttgaaaaagaactgagcccggaactgtctggaatcatcatcagcgcggagggcggaggcagtccaacagtaaaagctgaaatttctgaggccatggaagcattatttggcctgccggcacataaaataaaagtattaaagagggtggaataaataaaggagtgcaggatatgaaaatcaagaatatgaaacaggtaaaagagcacatgaaagacatgaacatgaaacgtctcttccgcaggaaccaaattatcatcacaacactggctgttatgattgcggcagccggatatctgaactatgcgggaaagaaggatttggcaagcggcaaccgggtgtatgaggcaggggccatggacatttcggatgaagatatcctggcggagaaccaggcggcttccttaaacggccaggccggactgcaggagattcccagtctggaccaggacccttctgacctggatgcggtgagcgatgcagacggcgcccaggcagcggcggacacaggagccggccagggacagctggcccaggccggagacggcacaggcgtggaggaggctacccaggcagctgacccggggcagatggcagcggcggatacggacagctctgcccaggccggattggagaatccaggggaagccgtacttaccagcggtatgaacgtggctgattacatagcaaacgtacagctcagcagagagcaggtgcgcgccaagaacaaagagacactgatgagcctgattaacagtgacagcattgacgaagcagccaaacagcaggctatccaggacatgattgacctgaccgaggtatccgagaaggaaaatgccgcagaaaccctcctgatggcaaaaggtttctcggacccggttgtcagcattaccaaggataaggtggacgtggtcattaatgcgccttccatcacagacccacagcgtgcccagattgaagatatcgtgaaacgcaaggcagaggtggcagcagaccagattattattacattgctgaatatggcagaataggcaggaatacagggaaagccgggctgccgctttaacggtcggaaaaccgtaaaggcggcagcctttttggcgcctttcctttcaaacttcccattgcaaccccttatgaatttccgtataatggaataaatgaccaatcatacaattgtaccgcagttccggtacaggatggaggatattatgagggaaatcccggaacagcagattgccgccatggctcccaatgccaatgcggtcagcaatgcaaggaaaatcgttaaaagcggaggttttacagaacatgccaggtctggggatgacaccttttacatgggtacctgcaagggcagcggcagttcagcctacagggtgtccctggattttgtggacggggacgtgccggtgtgccgctgcagctgtcccagcaggcagtttccgtgtaaacacggcctggcgcttatgatggagctgtcgcagggccgccattgggatatctgcagcattccccaggacatattggataagagggcgaagaaggacgccagggcaggaaaaaaggaagaacagggagataagcccaaggcccctaagaagacgaatcaggcggccaggacaaagaagcttaagaaacagctggagggcctggacctggccgagaaggtggtgagggagttaatggaggccggcctggggaccctgaacggaacgtcggtgaaggtctaccgggacctggcaaagcagctgggggattattatcttcccggtccccaaaggctggtgcagtccctggtgctggaggtggaacggcttaaggaggatggaaccggggattacggtgaggccgtaagaattcttgtattcctccgtgccctgataaagaagtcaagggtctatctgacggaaaaactggagcagggacaggtggaggacgacaacagcatcctctatgaggagctgggcggaatctggaacctggaacggctgatggagctggggcttaaaaaggaaaacggacggctgctccagctgtccttcggcgtcagctatgacggggccagaagagaatgggtggacaagggctggtggctggatttggacagcggtgagattgatattacctataattaccgtcctgtgaaggcgcttaagtatgtaaaagaagaggactccgtgatggaggcagtgagggtgcccatgctggtctattatcccggtgagaacggacgcaggatacgttttgagggccgggaattcctgccggtgaccggtgaactgctggcagaagcccgggataaggcctctgcttcccttccggaactggtgaaggcggcaaagaatgaccttaagaacacgttgtcggacggccggtttggatgcctggtattctacgacggactgggaacagccgtagcagaaggcgaggagggccagcagcgggaatacatactgcactgcggcggcagcaccatagaactgagggaccggccaggggacatgccgtctgtcagacgtctggatatcctgccggacaggcggatggcagagcatcaggtgatgttcggagtcctatggtatgacaggaaaagacataagatttgtctgcatccctactcaatcatcacggaaaaagaggtggtccgcctgctctattgatggacagacggaggaaaggaaggaattaccatggaattgcagggattatatgaactccatcagcgcctggaagcagcggcagtggccggagtgaacctgattggagatgatttccggcttaaaagggcggtggagcagattcgtcccctggcccaggcagtgccggttataaataaattgtatacaatggcggaaaaggccatggccccggactgtgaggaccgtccgggctgtctgctggatgcgctggccctgtcagaagcccttttgtgtacccaggccggatatgagacaggatataaaacagaacagaacagcggcgggccggagtctgggccggggtaccgtccgctggagctgatatcccgctgctacggtccctgcctgccctacagccaggtccatcccctggagcaggccctgactgagtcaggaggcgggcgtctggtccccatcaccgaggccatggaggagcatccccaggtctttgatgattaccgcctgcaggcagccgtcataacagctctctcagaccggtatgctgatattgcagatgaagctgaagcatttctgtctaagatggacagacagattgtgccccttttaaagcgggggtactgggaaaccacggataatgggaggctgcaccggctcagggtcatagaggccatatgccgtgaagaagaaaatgaattttataaagggcttctccaacgggccaaaaaggaactgcgggcagaggccatccatgccttcagatttgacacggaaaataccagcattttgctggacctggcccggaccgaaaagggaatgtgcctggaaatgacggagcaggtgctgggcatgatggacccggaacagacagacccatactgggaggaacagtttaagacaagaaaaaagggaatcgcaggctatctctgtttttccaaatcagacctggtttcagacaggctggccggaataatggaagaaaccttaaggcagaaggatactctggccaaaaaggaatttgccgggcttatgaacgagcttctcatggccctgccgggcaagggctcaccggccatacaggaattatatcgcagggcagccggaaagaacccgtccaaccaggagttttggtccggatttcccgccatgctggcggattcgattatctacagccaggatgaacggctgatttccctggcaggggaactggccaatgaacaggcgggaacatggctgggaccggcccttgcagctgatttcctgacaaagcccgcggcccttgtgtatgaatcctgctgccggaagattcccaggaattcccttctgggaaaagaggagaaacgcaaggccaggagggccgtactgtctgtgctgggccggattcactgcatagaggaaaacggggcctgtgaaatcatctgccgcatagaagaaaaggcgggggcagggacagcccaccggattgggcgcaggctttacgaaaaaccggattcccgctggacagacctgctgatggatgccaggatattcgggaatgagacagccatgggactggatgcagccggcaggcaatgtgaaacggaccgggataagattctgttttctatgctgccggccagggaacgggcagagaagggctcctatttttataagagggcgcttacggtgacggataaccgggggctttaccacattctggtacagtgcggctggaaggattttaaaggtcttataagcgcctatgtaaaaaagaatccaaatgcaggcataacgctgtgggccatacagcgccggatgagtgagctgcccatgacagaggaggaacggcagatggaaatccgtgagattgaccgtattatgtgcagctttccaaagggcagctctgagagaagaagctgggacgccaatgattactgcaggaacgccatcaaccaggctgccggacttaccgggcagggctgacggccatgtgtttttgggaaaataaagtgagacttggaggatatcatgggaaaaacaacaggaaaagaagagaatgtgcagcgtctgcctgcggaacagctttaccaggaggagattgacgcgctgattgcagcggagcagaacccggttcctgcgggctggagaatgagtccgcgctccgtactcacctatataacgggaggaaacgcgggtggaaaagaaattactcccaaatatattggaaaccgcaggctggtggaaatcgccattgccaccctggtgacagacagggccctgctcctgattggagagccgggaactgcaaagtcctggctctccgagcacctgacggccgccatcaacggggattccaccaaggtggtgcagggaacggcaggcaccacggaggaacatatacgctattcctggaattatgcaatgctcatagcccagggcccttccagggaggccatgattaaaagcccggtataccgggccatggagacaggcagcattgcccgctttgaggagatatccaggtgtgccagcgaggtccaggacgccctgatttccattttatcggagaaacgcatctccatacctgagctggcctttgaactgcctgcccggaaaggcttttccgtcattgccacagccaatacaagggacaagggagtcaacgagatgtccgctgccctgaagcggaggttcaacattgtcatcctgccgccgccgccggatatttccactgagatggaaattgtgcagtcaagggtggagcagctggccggaagcctggagctgggggccaggattccccatgccgaggtggtggaaaaggtgtgcaccattttcagggagctgcggggcggcatgacactggacggcaggcagaaggtaaagccgtcctcaggcgtgctgtccaccgccgaggctatttcacttctggcaggcagcatggccctggcaggcagctttggaaacggggaaataacggattacgacctggcggcggctttgcagggcgctgtggtcaaggatgaggataaggacggactggcgtggaaggaatacctggaaaatgtcatgaagaaacgcgggagccggtggcttggactttataaagagtgtaaggagttgaaccaatagatgggacatccatattgttttggtatccgccacctgtcgccggccggcgcatatcatctgagaagctttctggatgaaaagcagccggacctgattctggtggaaggtccttccgattttaacggtctgatggatgacatggtgagggaagagacaaagccgccctttgcggttatggcctttacaaaagacccgccggtgcgcacaatactgtatccctttgcagagtactccccggaatatcaggccattgtctgggccagggagcacggggcggagtgccggttcatggacctgccctcggatgtatttctgggaatccagcggaccagggaggaagaatttaataagaaatttgagccgggccaaaatgagcagccgggccaggatgaacagccgtgccaaaatgagcagccggtccaggatgcgcagcgcaccccgccgggttctgcttccgagcatgtgtaccggcttttggaccggttcagcggggaggacagtcatgagactttctgggaacgggttatggagcactccgaaaatcatgatgcataccgggacggagcggaaacctttgggcggcagctgcgggagctgacagcgggcagcgacagcgactggcctgagacactggtccgggaagcatatatgagaaggaagatggaggatgctgtaaaggaaggattccgggcagaacgaatcgtggcagtgacaggcgcttatcatgtggcaggtctgaccggagaggaaccatccatgacagataaggagatgggcctgctgccatcggtgccctgcaatgtcacgctgatgccctattcctattaccgcctgtcctcccgttccggctatggggcgggcaatgaggcgcctgcctactacggaatgctctggcaggcactgcaggaaggcggcagggatatggggacttacccttatctcacagccatatccgcttaccagaggcagcatggttttcctgtgtcctccgctgaggtgattgaggctgtggagctggcgcgctccctggcgaatctgcacgggtacagggtgccctccctgcgggatttgcgggacgccgcagtaactgccatggggcacggcagtttgtcggaactggcgctggccgtggcggatacggagattggcgcggctgtgggggagcttccgcagggcgtcagccggacctgcctgcaggatgatttttacaggcagctcagggaactgaaactggaaaaatataagtcggagacagcgttcacactgtccctggatttacgggaaaaactgagtgtgaaatcagaggcagctgcctacagagagctgcaccagtcatttttcctgcaccgcctgcgggtgctgggagtccattttgcagtcctgagaaaggaacggcaggaaaccgccacctgggctgagagctgggatatccggtggactccggaagtggaaatagagctggtggaggctgccctgaaaggtgatacagtggctgccgcagcatcctttgtcatgaaggagcaggccatgcaggcggagcagattggagaggcggctggtatcattgaggccgcatgctgctgcgggataccggagatggtcacctatgccacggatatcctgcagggactgtcggtggaggcagctggctttctggagctggcaaagacagcggagagtatttccacggttgtgcggttcgggaatatacggcatctggacagcgctccccttctgcctgtcctgaatcagatgttcctacgggcctgcctggtgttcctcaattcctgcggctgcgacagccaggcggaaaagggtgttatggaagccattgaacgggtcaacagtctgtgtattcaccatgatttcctggatgaggagcggtttatccgtctgctggcggaggctgcatccagggatgacctgaacacaggcatatccggttttgctgccgctgtgttactggaacggggacggatggaggaagaggaattaagccgtgaggtccaccgccgcctctcgaaaggaattccggcggaactgggagccggatggtttgcaggactgtcaaagaagaaccggtatgcgctcattgccaggctggatttgtggcgggagctgagcgcctatatggatacgctggatgacggggagtttaaacgggccttggtgttcctgcggcgggcttttgctgatttcagttccagggaaaagctggatgtggctgagaacctgggcgagatatggcaggtgaacacggcccaggcgggagaggtgctgaacggaccgttaaaggacggggaaatggagctgctggacagtctggaggggtttgattttgacgatatataggatgggtgaaaaatatggagcttgaaaccagaatgaaacgatggcgcctgatactgggtgaggaaagcagtccccagtttgaaaaaatgggcggtggggagctgacaggtgagcagcttttaatggaccaggcccttgcgtccatctataatcagacggactccggtggatttggaaacgggacaggaaaaaacgcgccgggaggcaggggagccggaaagggtccgtccgccccggtgctgtccaggtggctgggggatgtcaggtccctgtttgacaaggaactggtaaccatcatccagtccgatgcaatggaacggtgcggtctaaaacagctgctgtttgaacctgagctgctggagaatctggagccggatatgaacctggcttccatgatgctggctttaaaagaccagataccggtgcggtccaaggaccaggtgaggctgttcattgccagaatcgtggaggaaatcaataagctgctggctgacgatatccgcagggcagtgacggccgccgtggacaggaggcggcattctcccataccatcggcagctgccctggattataaggctactatacgcagaaatctaaagaactataatcccgagctaaagaggctggtgccggagcatttttatttttatgacaggaccacgtccaatgcggccaataaatatacggttattctggatgtggaccagagcggctccatgggggaatcggttatctattcctctgtcatcagctgtatcctggccagcattgcatcggtgaagaccagaatcgtggcctttgatacaaaggttacggacctgacggagaaatgtgaggaccccgtggacctgctgttcgggttccagctgggcggcggtacggacattgagaaatccgtggcctattgccagcaattcatggaaaatccgggaaagacactgttttttctcgtcagcgacctgatggaaggcggaaaccgggccggacttctcaggcgtatcctggaaatgaaggaatccggggtaaccgtggtctgtcttctggccattgcggacggcggaaagccttactacgacgagcagattgcgggcaggattgcatctatggatgtgccctgctttgcctgcaatccccagaaaatgccggagcttttggaacgggcccttaagggacaggacctgaacgcattccagaaggaactgtcacggacagccaatgcattctgaacgggctttcagccggttaaaggctctgtcagagctggtatcattgagaaagggcgttaaaattaatcctatacatatcctcccggatttgttataatactaataattaagtcttgacaggaggtaagttgtgatgtctgaggaaaatcgcagtacccataaattatacgaaaaagaaaagataggcgaagtacagattgcagacgaggtagtggccattattgcaggtctggctgccacagaggtggagggcgtggattccatggccggaaacatcaccaatgagctggtgggcaagctgggcatgaagaacctgagcaagggagtcaaggtggatgtgaccgaggagcatgtgtcggtagacctgtcccttaatatccgctacggatacaacatcccggccgtaagcgagcaggttcaggaaaaggtaagcacggccattgagaacatgacagggctgaccgtgctggacgtgaatgtaaagattgccggagtcaatatggacgaaggcagataaaaccatggtttaatataatatctgtaaacactccccggagcgttgcctggggagtgttttatacattttttattgtttttatgcactgggtttgctataatatctagagcagcttcatccccgggttatttaggacacgccctgacaagggaggaagcggacatcacgaagaaaggaaaatgtacggaaagccgttgctttttggtacaagcagagaaaatgaccagaagagaattgcgggagcattgttttaagatgctgttctcggctgacttctacccgacacaggaagaggccatagcccagctgggccagtatttccagtccccggaagaagacgatgtagatgagtcgggtattcttcaggtattgcataaagtagaattaaaagaggcggacagtgaatatcttcaggcaagaacagcaaacataatggagaagattcctgagatagatgagaagctgaaccaggcggcagccggttggaagaccaagcgtatgggaaaggtggaactgaccatcctgcgcctggccctgtatgagatgatttacgatgacgccattcctgagaaggtatccatcaacgaggcagtggagctggctaaaaagttcggcggaaatgattcaccgtcctttgtaaacggaatattggctaagtttgtaagcaagggaaccaaggcggccggggagaacagggcggcggaggaaacccaggacctccaggcgtcccaggatgtccaggcatcccaggacaccaaggcgccccaggactccaaagcgtcccagggccccgcggataataaggaaagcgaagcgtaggcaggacgtatggcaagtgtttacaccgtatctcaggtaactgcatatatcaggaacatgtttacacaggactttgccctgaaccggatttccatccggggagaggtgtccaactgtaagtaccacacatccggccatatctattttacattgaaggacggcggcgcacagattgccgccgtcatgtttgcaggacagaggaaagggctggactttgagcttcaggaaggccaggaggtcacggtgtcaggcaccgtggatgtgtacgagagggacggaagataccagctttatgcaaaggaaattaccagggaaggaaagggcgacctgttccgccggtttgaaaagctgcggaatgaactggaggagatgggaatgttcgacagctgctacaagcagcccattcccaggtatgccagaaaggtgggaatcgtcacggccggcacaggagctgccatccgcgacatcatgaatatttccgccagaaggaacccctatgtccagctcatactatacccggccctggtccagggggagcaggcaaagtacagcattgcaaagggcattgaaacgctggaccggatggggctggatgtcctgatagtggggagaggcggaggctccattgaggacctctgggcatttaatgaagaaatggtggccagggccatcttcaactgtaccaccccgattatctcagccgtagggcatgagacagacgtgaccatagcggattatgtggcggatttaagggcgcctacgccgtcagcagcagcagagctggccgtgtttgattacagccagtttacggagcaggtgaatctgtacaggcaggtgctggaacgctccatggagcgcaggcttgaaaaggtgcatttccggctggaccagtgcggtatgcgtttgaaacttctaagcccgcagcgccagctcaatgacaggcgccagcgtctggcggatatggagagccgtctggggcggatgatggaggaacagctgggagatgcccggctcacgctggaggacaggaaacggcgtcttgaggcgcggatggctgccggacttacagagggaaagcacaggctggcactgctgtccggaaggctggacggattgtcgcctcttaaaaagttagggggcgggtatggctttgtgacagatgcaaaaggcagggcattcacctccattgcacaggcagggacaggcgataccatacgcataagcgtgaaggacggacgtgtggatgccctggtcacgaacacagaatccatgaaattaccgggaagtgagggatagaggatgccgcgtaagaagacggatacacaggaaaaggaagagaataaagccagcattgaggagaatttcgcccagctggaagatattataaagaaactggaagccggggacagtacgctggaggaatcattcacctgctatgaagcggggatgaagctggtgaaatccctgagcggtcagatagacaacgtagaaaaacagattctaatattgagtgagggtgacgaaaatgagcgataaggaaacatttaaacaggaacttgatgcgcgtacagcagaaattgagcagttaattggaacttatcttccggaggaaacaggccatcagaagacaattttcgaggccatgaactacagcatgaaggcaggcggaaaacgcctccgccccatgctcatgcaggagatgtgccggctttttacaggcacccttttggaatccgtgataccctttatggcggcagtggagatgatacacacatcctccctggtgcacgacgaccttccctgtatggatgatgacatgatgcgccggggcaaggccagcacatgggctgagttcggcgaggacatcggtgtgcttaccggggatgcgcttatgatgtatgcctttgagacagctgccaatgcctttgagacaagcattgacccggacgaactgtccaggattggacgggccgtgggcattcttgcccgcaagaccggggtttacggcatgataggaggccagaccgtggatgtggagctggccggaggtcctatacccgagaacaagctggatttcatctaccgtctgaagacaggagcgcttattgaggcttctatgctgattggcgctgttctgggcggagctgccgaggaggactgcaagatagtggaatcccttgcagccaaaatcggaatggcattccagattcaggacgatatcctggatgtgacgggaagccaggatgtgaccggcaaaccttcaggaagcgatgaaaagaataagaagaccacctatgtaaccctggcaggcctggagaaggccaagaaggatgtggagcagatttctgcggaagccatcgaggagctgaacaagctgccgggaaacaatgacttcctggagcagttaatccgctcattggtgggccgtcagaagtaagactggagataccgttattatgatactggaacaaattagtgggccggaggagctgaaagccctcccgcccgaggatttaaagatactggcccaggagatacggaccttcctgattgaaaaaatcagccataccggaggacatctggcctccaatctgggcgtggtggaactgaccatcgccctttttaagaccttaaaccttcctgaggacaaggttatctgggatgtggggcaccagtcctatacccataagatattaagcgggcgcatggctgaatttgatgagctccgtcagtacggcggtctcagcggatttcccaagcgcaaggagagtccttatgattcctttgatacaggccacagctccacctccatatccgcaggactgggcattgccctgggacgggatatcaggggtgagaactaccgagtggtgtctgtgattggagacggggcccttaccggaggcatggcctatgaggccctgaacaatgccgcccggatgaagaagaactttatcattgtgctgaatgacaataagatgtccatctcggaaaatgtagggggcatgtcccgctacttaaacggcctgcgtacaggcagcggctacaacgacctgaaaaagagcgtggcagatgccctggaccggattccggtggtgggcactgccatgatagacaaaatcaaacgcaccaaaaacagtataaagcagctgtttataccaggcatgctgtttgaaaatatgggaatcacctatctgggaccagtggacggccataatatccaggccctctgcaaggtgctgagggaggcccagaagctggaccacgcagtcctggttcatgtgatgacaaaaaagggaaagggataccgcccggcagagaagaatccgtcctattttcatggggtgggaccctttgacgtggaaacgggcaaatccctgtcagcccagaagaatccatcctatacggatgtgttctccagaaagctatgccagctgggggaggagcatccggatttggtggcggtcacggccgccatgcctgacggtacggggctggctgcctttggaaagaaatacccggaccgcttttttgatgtgggaatcgcggaagcccatgcagtcacatccgcagccggtatggcagcagccgggctcaggccggtggtggcggtctattcctccttccttcagagggcctatgaccaggtcctccacgatgtctgtatccagaacctgccggtgctctttgcagtggaccgggcagggcttgtgggaagcgacggggagacccatcagggaatctttgattattccttcctgacctccatacccaatatgagcgtcatggcccccaagaacctgtgggagctgcgggccatgctggactttgccatggattacaacagtccactggctatccgttatccgagaggcgaggcataccgcggactgaaggagtttaggcagcctgtttcgtatggtgcgggtgaaatgctttacgaggaaggggacattgctctccttgcagtgggaagcatggtcagcacgggggagcatgtacgggagaagctgaaagcagaaggatacagatgcagccttgccaacggcaggtttgtgaagccctttgacaggaaaatggtttcacgtctggctgagaggcaccgtctgattgtcaccatggaggaaaatgtgctccagggcggatacggcctggctgtcactgcgtttatacatgaaaactatccggatgtaaaggtacttaatattgccattcctgacgcatatgtggagcacggcaatgtatccatattaagagaaggcctgggaatcgacagcgattccattatacggaccatgaaggccagcggctatatagggccggccgcacaggaatccccggaagtctgcccggttccggacaaaaaccaagcttgaacatatgtatccgggcggatagctgccggacaatgtacggcggaaaagcctttgacaggtatcagataacacaggcggcattgcccccttaagccggaaggcagcagggagatgccgtttcggcataaggagaacggtaatgaagaaagaacggttggacgtgcttatggtccagagaaacctggcggagtccagagaaaaggcaaaggccctgattatgtcagggatagtctatgtcaatgggcagaaggaagataaggcaggcacgtcctttgaggagacagtacagattgaggttaggggaagcacccttaaatatgtcagccgcggagggcttaagctggaaaaggccatgagccatttcggcgtggagctggccggcaaggtatgtatggacgtaggcgcttccaccggcggatttacggactgtatgctccagaacggcgcggtgaaggtgtatgccgtggacgtgggccatggacagcttgcctggaagctgcgcaatgacgaccgggttatctgcatggagaagaccaatatacggtacgtgaccccggaggatattggggaccgcattgagtttgccagtattgatgtttcttttatatccctgaccaaagtgctgggaccggtaaaacagcttctgacccagaacggccaggtggtgtgcctgataaagccccagtttgaggcaggacgggaaaaagtgggaaaaaagggcgttgtcagggaaaagagcgttcatcttgaagtcatagagatggttatggggtatgccagaaccattggctttggcatactgggcctggaattctcacccataaaggggcctgagggaaacatcgaatatcttctgtacctccagaattgtccgcaggaagaggcggggcaggaggaaaacaggcaggaggaaaacaggcaggaagtaaccaggcaggaagcagccaggcaggaagtatcggcccgggccatagtggagcaggcccatggctgtctggattaaacagcccacggcctgcacaaatggataaataacgtataaaaacgtcaggagccccataaccatgaaacatttttatattattgccaatcttgacaaagaatatgtacaggaagcccaggtattcatcaaagggtacctggaggcaaagggagcagagtgccttctgcaccacacacctgagagaaccagggggggagcccatattgacggggcccaggtgccggaggatacggagtgtgtcataacaatcgggggagacggcacccttatacaggcggccagggatttggcgggccgtaatatccccatgctgggggtgaaccggggccatctgggttatctgaatcaggtgagccggcaggaggacattgcaccggtgctggagtccctgctgaatgagcgctaccagctggaacggcggatgatgatacagggaactgcatggcgggaggaagaggccattttaaaggatattgccctcaatgagatagcggttaccagaaaggaccctctgaaggtgctccgctacagtgtctatgtaaatgacgagtatctcaatgaatacgcagcagacggtgtcctggtggccacgcctacagggtccacggcctacaatctttcagcaggaggaccggtgatagcgccgggggccaggatgatggtgctgacgcccatctgttcccattccctcaatgccaggagtattgtgctggctccggaggaccgggtccggattaaggtccttaacagcggccaggtcgtatcctttgacggggatacgtccatggagttaaaggcaggagactgcattgacatccaatgttccgggctgcagacagtgatgctcaagctaaagcagatatcattcatgcagaacctcagcaaccatctgggaggattatagccaacccatggtccgcaggccattataaatcaacaaggaggggagcgtctcacatgaaagtagagcgccacagcaagattgtcgaactaattggaaaatatgagatagagacacaggaggagctggcagagagattgaatgaggctgggtttaatgtgacccaggcaaccgtctcccgggacatccgtgagctgaagctgaccaagatgcagtcggagagcggcagacagcgctacatggttctggaaagccccagagggacatctgccattaaatatatccgtatccttaaggacggatacatgtccatggacatggcccagaatatcctggtaatcaagaccgtatccggcatggccatggctgtggctgctgccctggacgccatccagtttcacgaaatcgtgggctgcattgctggcgatgataccatcatgtgtgccatacgcagtgtggacgacaccatcattgtcatggaaaaaatcaagaaaatggtggaagactaacggaaaaggggtgtaatatgttactggagctgcatgtaaagaacctggcccttattgaaaaagcggatgtggaattcggcgagggcctcaatatccttaccggtgaaaccggagccggaaaatccattatcatcggttccgtaaccatggccctgggcggcaaggcgtccaaaggcagcatacgccccggggcagactacgcctatattgagctggtattttccgtcacaggggaagagaagcggaaggctctcagggagctggaggtggaacccacagaggacggactggtaatcatatccaggaagctgacccctgccaggagcatcagccgtattaacgatgagacagtgaccatggccagactgagccagattacaggactgctgctggatatacacgggcagcatgagcaccagtccctgctgtacaaatccaagcatcttgaaattctggacgcctatgtcaaggccgcgacccagcctgtaaaacagacaattgcagacaggtaccgtatataccgttcccttgaagaaaagctgggagggtttaatttggatgctgagagccgtatccgcgaagctgacttcctgcggttcgagatagaggagatagaggcatcagccctgaaggaaggggaggaggaggaactcacctccctctaccgccgttattcccattccaggcgtattgcagaatgtctgggggctgcctacggggcagtggagggagaatggctttcaagggccttaaaagaggtggagcaggccgctgagtacgatgacaccctgggcggcatccgggaccagctctatgacgcggattccatactgagggatgcaggaagggaaatgtctgcctacctggattccatggaaatggacgaggaaacattcaggaagaccgaggaacgcctggacctgatacataaccttcaggcaaaatacggggcaacagtggagattatccgccaaaagctggaacaaaaaaagaaaaagctggaagaactggaagattatgacgcccacagaaagcgcatggagcaggaattagaggcatgcaggaatggattggagaaactctgcgcacaattaacagggatacgtaaaaaggcatccagggagcttgtaaagaaaatcaagcagggtctggaggacctgaatttcctggatgtggaatttgacatggaatttgaaaaactgggtcactttacctcgtccggatgggacgaagtccaattccttatttccaccaatcccggacagcccatgcgtcctctgaaggatgtagcgtccggaggcgagctttccagaatcatgctggccattaagaccgtgctggcggattccgacgacatcccgaccctgattttcgatgagatagacaccggcatcagcgggcgtaccgcccagaaggtatcggagaaactaatgctcatagcaaagaaccaccaggttatctgcatcacccacctgccgcagatagcggctatggcggattcacattttgaaattgcaaaatctgccagccagggcaggaccataaccaccatccgcctgctggacagaagggcttccatagaagagctggccaggctcttgggcggcgccaggattacagaggccgtacttaaaaacgcaggtgaaatgaaggaattggcagacagaacaaaataaaacagattgaaatcctaaggatggataatactaagaaagaggcagcgaacattgcttctttctttttttgttatggtccatccgcagcagatgcaccatggctttgtattgacccattttaaatgaatgactatataaggaggcagggcgatgaaggggaaatcaatcttttaccggtggctgggacgcatcttctggctgtccgttgtggctgttacggggtatacgtggtattacatggaccaggcagtgccggaccgggtgagcattatagaaaatgaagaggaggaattttccttcggcctgcctttgaaggcaaccatatccagcggcagccaggaagtggccctggcaaatgaaagcaacataccggcggaccagattaccataagcggcagggaccgtttttccatgtttgggggagaaaagggaagctaccaggtaggtcttaagctgtttggggtgataaaattaaaggacatacaggtggacgtggtggacaccagatatgccattccctgcggctcccccataggaatctatctgaaatcagacggcgtcatggtcatcggtacaggacgtataacgggaagcgacggcatggaggtggaacctgcctacggtatactgaaatcaggagactatatagaggcatttaacggaaagcccatgaacacaaaggaggacctgatacgcgctgtcagcgagtcaggcggacaggactgtgtgctccaggtgcgcagggaaggcgaggacgtggatgtgagcctgaagccggtccagggcgctgacggacagtacaagctgggagcatgggtcagggacgatacccagggtatcggtaccattacttatgtggatatgaacggcagattcggcgccctgggccatggaatcagcgacagcgatacaggagacttggtggaatcctctgacggcgccctttattccactgaaatcatgggaattgaaaaaggctccatgggcaagccgggactgctgtccggcgtgatttactacggcccccagtcccatatgggggatattgaaaagaacacaaatgaaggcatattcggcaccgtcaaccagcaattcaaaaagcagatagtgggagagcctctggaaatcgcctgccgccaggatgtgaagcagggaccggcctatatccgaagcaatatttccggcgaattaaaggattatgccattgaaattcaaaaggtggattataattccagccataagaacaaaagcatggtcatcaaggtgactgacccggagctgctggagctgacaggcgggattgtgcaggggatgagcggcagtccgattatacaggatgggaagctggccggggcggtgacccatgtgtttgtgcaggatgcgagcagagggtatgggattttgattgagaatatgttggagcattaatggtgaggagcagacggaagacgagggcgcagctgggagccagctcacagttgcgccctcgtctgtagtatgctatgcggcgaaggccacacaaccgctggtgtgcggagcgtgtcagcggttgtggcctggacggagtagtggggcgcgacaggagcttactaatagatactgcttgttgtaagaatgtggatatgttattatagagatgttagagtgcaggaggtaagatgaacgagcagattgtttttccgccattagttgaggacgaaaaagaagcctttaaacagaaattatttactacagaattgtgggatacagcattggctcgccggaatcagcttttaaaagtacattcgactaatgtctcaaaactggctcgcaaatttgcaggaaaattcggcatggaagctctcttggatgttgcaggatatttacacgattatggtaaagccacactggaatggcaggaatattttaagaagatgttgcacgaggatgtagcaatcgttcctcacagtattcatggtgcaaaatatggttttgctaaagctaattcataccattatatcgctgaattactcggaaacgttattatatacttactgctctcgatgggctaaagatagaagaacttgatggtcaatagacatatggttcaggactaaaacgtattttgattgatggagaatatatgaatattaactcgattttaaataaaagctttcatgaattaacaccggatgactgcgttgcgataaataattatctgttggacaggatgttaatcgaattacagaaaaaggatcgaagcggtatctatggaattacccagagagaatttgcctataattcaaatcgcatcgaaggcagccggctgtcaagagaacagacggcgtcattatttaataccggaacaattatgtccgatggagagatttaccgggctaaggatattgaagaaaccaatggacattttcttatgtttaacctggccttaaaaacattcaacgaggtattatcggaaccccttattaaacaattccatgcggcgcttaagcagggagtatttgaggaccgggccaatggttatccgattggggagtataaaaacagacagaatgtggtgtgggatattgaaacagttaagccgaatcaggttcatgagaagatgtgtgaactgttgggaatctatcttaacagcgaaaaatctctaatcgatattactaaacttcatgccgaatatgaaaaaatacacccttttcaggatggaaatggacgcacaggcagaatgattctattccgggagtgtttgaaaaatgggattattccatttgtgatttgtgatgagaataaaaatcaatatacacatcttctaaatgctgcgcagaaaacagaagattttgcggcattggcaggttattttgaggaggaggcgtgtaagtattacgaaatacttcaagaatttttgagagtatatgaaaataaagattaaaattgttatcccttacatgactcactcgtgagcggtagtccaattatacaagatgggaagctggccggggcggtgacacatgtgtttgtacaggatgcaagccggggggatgggattttgattgagaatatgttggagtattgagggtgaaggaataagcacaaaatggctgtgattcaaccaaaatcaaaactagagtagatgaggaaaggctttcggaagattacgaattatccttcatcatataagtgcgaatgccaagtgaacaggaaaacttgtggggattcgcaccctttttaagggactttgagtaaaaaaaatcaaaggagatgcaagcaattgtagaattatgagataaaattgtacaatatgtatacaatgtgactgatgtgaaatggaaagattggatatgtttgctgtcagcttctgcgaagaagctgtggattgaaatgtcttccatcctgccattgccatgtattccaggccgtcagcttctgcgaagaagctgtggattgaaataaataatcatcatgggaaaagttgcgggaatcaggtcagcttctgcgaagaagctgtggattgaaatctgatgtgcgggcggtgtttcacactaggaatagacgtcagcttctgcgaagaagctgtggattgaaatgtacatatagcattgggaggataatctcccctaggtcagcttctgcgaagaagctgtggattgaaatgtaagaatccgtcctacggctacggcagtccaatgtcagcttctgcgaagaagctgtgaactgaaatggttgttgccataggtttccacaatctggtgcatgtcagcttcttcgaaaaagcagcaaattaaacaccagaaccgcaaccatgacacgcccatgcatgtcacctccttcaaagaatccatagaacaaagcaatcatttcccatatcatccgataatgattggctcgtaggaggcatctgctgatgcctcccataccaatcaaatgaccatgagcatgtcgtcatacatcgctccgcactctttcccatgtcattcttccgccctcaatcactccccctcgtcaaaattcgacaaatcccgtcgctccccctcccgaaaatctgccaaagttttaaatatcaggaggaaaaacagtgatgtttgcgttctataatcgtgcctgtgagaatataatgaaatgaaacatcaacgtgctgaaattacaaaaatggtgtcgaattaaagtaaaataaagtaaaaaaaccaattatttgttacagaaatgttaatcgtcacaattaataattgcaaaatgacaccaaaaatgatacaatttaatctcgacgcgtgtctaaaattgcgaccacgaaccgttgatatatggtaaggggaccatatataataaatttcgccaggagttatattgacgaaggagatggatttgatgtagaggtggtcgaatagcagctaccgattttttgacaggtagttcagcacaggcaaacaattttaggaggtaaaaggaagtggaaaagctgaatgttgcgattgtcgatgacaatccgctaattctgaatacgctggatgaactgattaacgcagaggacggattatctgtaattggaaaggcagacaatggcgctgatgccattaacatgattgttgacactacgccggacattgttctgctggatttggtaatgccgaaaattgacggtatatccgtggtggaaaaagtgaaaagcgagcatactttcctgaaaaatcctgcatttattatacttagtgcagtaggtggtgaacagatgacagaagatgcctttaaggcgggagctaattactatctgatgaaacccttcgacaaggaaatcctggtaaacaagattcgtcatatcggtaaactgcctgataaacaaccggcaggaaaagtattaacggctccgtttgagccaggggaagaatcccatatcaccagggaggagtacatgaaggagcatctggaaacggacatcacaaagatgcttcacgagctgggcatacctgcccacatcaaaggatatcagtatctcagagacgccatcgccatgtcggtggaagaccaggaaatgatgagcagcgtgacgaaaatcctctatccggccattgccaaacgcaatcagaccacggccagccgggtggaacgagccatacgtcatgccatcgaggtggcctggggcagaggcaagatggaaaccatcgatgaagttttcggttatacaatcagtaccggaaagggtaagcctaccaattctgaattcattgcgctgatatcggataaaatactcttggaatacaaaaaaatttaagacaaattcatcagaaagaacttcctaatttcggaaaagtaaggtatactattaggaaaggcatatggaacctgttcgtcaggagagggaggttttgatgaagaaaatactatttgcagcttcagaagcagtgccgtttattaaaacaggaggactggcagacgtagtgggctccctgccgaaatgctttaataaagagtattttgatgtcagggtcatcatcccaaagtacctttgcatcaagcaggagtggcgtgacaggatggaatatgtgaaccacttctatatggattacctgggacagagccgctatgtgggcattctacagtacgtacatgaaggtataaccttttactttattgataatgagagctattttagcggagcaaagccatatggcgactggtattgggatttggagaagttctgcttcttctgccgggcagccttatcagcactgccggtgattggattccagccggatgtggtacactgccatgactggcagaccggactgatacctgtccttctcaaggataagttccacgaaggcgaatttttctgcaacatgaagtctgtaattaccatccacaacctgaagttccagggtgtgtgggatgtgaagaccattaagcgcttcacggaactgccggattactatttcgcaccggataagctggaagcctacaaggacggaaacctgttaaagggcggtattgtatttgcagatgccatcaccacggtcagcaacacatatgcagaggaaatcaagctgccgttctacggcgagggactggacggccttatgcgttccagggccggaagcctaaggggcattgtcaacggcattgactacgatgagtttaatccggagacagatacgtacatcgcccagacctataatgctaaaaatttccgcaaggaaaaggtaaagaacaagaaggcgctccagcaggagttaggccttcctgtggatgagaagaagtttatggtgggaattgtctcccgtcttacggaccagaagggctttgacctgattcagtgtgtcatggatgagctgtgcaacgatgatttgcagctggtggtcctgggaaccggtgaggaacgttatgagaatatgttccgccactatgactggaagtaccatgacagggtatctgcccagatttattactcagaggccatgtcccataagatttacgctgccagcgacgcatttctcatgccatccctgtttgagccctgcggtttgagccagctgatggccctgcgctacggcacagtgcctattgtcagggagacaggcggccttaaggacacggtggagccctataatgaatacgagagctcaggcacaggattctcctttgccaattacaatgctcatgagatgctgggaagcgtacgttatgccaagtatgtctacagcagcaagcgccgtgagtggaataaaatcatcgacagggccatggccaaggattattcctggtggacctctgcctctaagtaccaggaactttatgactggctgattggatattgacaacagacctgtaatgtcggataatatgctgatgaactaagaaaggtgtgatgcccatatggagccgtcagtggtttcagagataacagaagacgaggagtatatggagtgcgtaaaggacatactgtgccaccctgtattccagtccatggaccagtatatacagcacgggagtactacatgcaagacccactgtatacaggtttcataccttggatataagctgtgcaaacagctgggaggaaattggagaagcgctgctcgggcagggcttctccatgatttgtttttatacgattggcatacccatgctaaggagacgggccagtacttccatggattcacccatccaaaagcagccctggtgaatgcagaccggcatttccggctgacagaggaggaacggatgattatcctgaggcacatgtggcccctgacccttgtccctcccacatccagggcaggatatgcagtaacttgtgcagataaatattgcagtacagtggagaccacggcccggtttaagcactggatacggatgtgcctgtttgcgcagcccgccaggaggtaagcatgtgttttgctgaaaccgttccaaagcccgtttgaaaggggaaagaataatccgattatgaatgtatggacacagatgctcggcaatcagcttcttatgagtgctgttacaggatgggtggttgcccagttcttaaagactctgattgattttgctttaaataagaactttaacgcggagcgcctggtggggtcaggcggcatgcccagttcccattcagccacggtctgcggcctgaccacagcggccctgctgaaatacggggccgggtcctttgaatttgccgtgtccttcgtgctctccatgattgtcatgtatgatgccatcggagtgaggcgggaaaccggaaaacaggccaaactgctgaattccattctttcggagaatccgcttaagctgaatgcggaagtgcttcaggagaagcttaaggagtatgtgggacacacgcccctgcaggttctggcaggggcaatactgggaattgggctggctctggccctgaatccctattattaacacggcggggggtatcatgttagacaggaaggacagaagataccatgaatatttatgatttcatcaactggttttttatgtatagttttcttggttacctgctggaatgtatggtgctgagtgcagaatataagcggcctgtggtggaccgtggctttggccatggccccttttgcatcatatacggcttcggcgccctgggagcctgtatgctgctgagacctgtcgcaggcaggcccatggagctctacacagcatccatggccatggctactaccatggaactggtcacggccaatattatggtccgcctctttggttccttctggtgggattacagccataaaccctttaattacagaggaatggtttgtctggaaagcagtcttgcctggggacttttgggcctgtttttcttttattttctggatatcagggtgcgcgctgccgtgattagcctgcccggccatgtagggactgtcctggcagtaggacttaccatgttctatctggtggatttcatccactgccttcgtctgcgcctgggcggtatggaagaggaagatgagccggcagtgggccggctgaaaatatattgattggatgaaaggctgctgcaggtggctgttaccattggcctacatgcagcagtcttttcgccattctgtcccgccctgtttttccggcggattggataaaggagaatgacatggatatgagacatacttggggaggatttaatgtggtgctggcctcggcatcccccagacggaaggaactgctggcacaaatcggcctggagcctgaaatcaggcccagccggatggaggaggaaaccagtgagaagaaaccggacatggtggtcatggaactgtccagacaaaaagcagaggatgttgcgtctggttgtcctgagggcactatggtaattggggctgatacagtggtttccgttggaaatgagatactgggcaagccgggaactcccatgcgggcctatgagatgctggagaagattcagggcaggacccatcaggtatataccggggttacggtgctgctgtgccagggggaggaaaggtgccatggcatcacatttgcggagcgcaccgatgtccatgtgtaccctatgacctgcggggaaatgaaggagtatgcccagtgcggggaacctctggataaggccggggcctatgggattcagggcaggtttgccgcttatatcagaggaattgacggggactacgccaatgtggtgggtctgcccgtgggacgtctctatcaggagataaaaacacttttggaggacagggaagatgattaagctgatagtatcggatgtggatggaacccttgtgccggacggttccccggatttggacccggaagtattcgacatcattctggggcttcgggaaaagggaatgcagtttgtggttgccagcgggcgtccgtgggccagcgtggaaagcgcatttgagccggtaaaaaagaagattttctatgttgccaacaacggggcatatgtgggatgccacggcagatgcctgtatgcctataccatggaccgtcagctggcccaccgcatcatccggaaggtgcgtatgcatccggaactggagatggtctatgccggtgtaaacggagattatctggattccaagaacgatgccctgtgcgactggctcaccaatggctataagttcaatgttatccgggttaaggatgtactggagctggaggagccgtgtgtgaagatttccatttataagaaggagggaatcgaggcagcaaccagggacatatacgatgcgtttaaggacgaggcaaagatggcctgcgcaggtgacatgtggatggactgcatggccagggatgtgaacaagggccgtgccgtacgcaccatccaggaaagcctgggcattaagatggaggagaccatggcctttggggaccagctcaacgatatagaaatgctgaaccaggcctattacagctttgcggttgccaatgccagggaagaagtacgcagggcggccagattccaggcggacagcaatgtgcggggcggagtcctcaagatactgaaagggctgctgtgagaggagcgtgacagtggacagaagcaggatatacaagggacgggggaagagatggaaaaggaccttgacattgtgcctggcagcagtcttggcactggctgtttttagcgggtgttccagcaagacagccgcaacgaccggttccaggaccgtggacaaggagtataccaggggacagatgatggttatagccattacagagcgcaaccggtaccagaatatatataccagcgagctgtggtccgtaaaggcagacgagaacggtgatacatttgaggacaagctgatggaccaggtggagcagttcctgatagagctggccaccaccaacctgatggcggatgaacagggaatcgaacttacgagccaggaaaaggatgcccttaagtctcttgcccaggaatattacaggaatttatcggagcaggaccgcaggttcatggatgtatccgaggacgaggtgtatgacctgtactgtgaatactaccgggcggataagctggtggcggagctgaccaaaaacgagaacctggaggtcagtgacgcggaagcaaaagtaataggcatccagcagattgagctggattccagggaggaagcagagaatgtgctggctctggcccaggcggaaaaagcggattttggagccattgctgtaaaatattcaaaaaacagccggacagacagaatactggagtggcagaaggaaatggacggccttgacagggctgcgtttgagctggagcaggaccaaatcagcggaattctggagcagggcgaaagatattatattctgaagtgtgtcaatgcctatgacgaggaggccacggctgccagaaagagcagactggcccaggaaaagaagacaaaggcattcctgggaatctatgagccctatgtaaaggagcatactgtaaagcttaaaaagctgcccggtgacgtggtggagttctcaggcggcgaaggctgcacagcggataattttttccagctgtatcacggatacttcagcaaatagtgtttacggtgctgcaacagcaattgatggatttcgatggctttgcagcactttttacggtatttacattattgcatatacattaaggaaagcacaggtcactggttaaagggataaattgacggaatatgtaatttgatgtaatatattaaagagatgttaagaaagacagcaaataatgattagcaggagggtttgcaatgttcgatttaggtaaatgtattctggtcacaaataatgaccgggcagcagaaaaatggggggacaaggtagagcaggtggttctggtggaaacctatgaggaggtactgttaaaggcaagggacctgattcataccaaccacaaacttctgacccatccccaggcgtccagtttaaagcccaaccagacgccctacaggaccattcttttgtacaatgaaacaggaaaaagcgatgcaggggacatccgcttgattgaggaggccattgatgcatttaataagtggactgccattaagaaggtgcccaagtatgacgagaagattgcctacgattacaagaccattgatttgtcaatgatagaaaatgtaatccctaaattatagggataataaggaactgaatgtgaggaagtcatgaaaaagaatgtgggaacatcctactttaaagatttgagcaggaaggattatgtggttcaggccagcagaatcataaagaaggagggagtggaggccatcagcatccggcgcattgcggcagaactgggatgttcatccgccagcatgtaccggtatttccagaacctggacgagcttttattttatgcccagctggatgcgctcaatgagtatatcctggatttgtcaaaatgcgagaaggattggaatgatatctgggatgtgcatttcggcatatggcgttcctatgcaaaggaagcttttaaaaagccccaggcctttgaggctgttttttaccggaacatcaaccgggacctgggtgaggcccttaaggaatactatgagatgtttccggatgccatcatacaggtaagccccttcatcaaggagatgcttgagattcccagctattaccagagggactattacatatgtaagcttctggtggctgagggtaagatttcagaggagaatgcaaaaaagctgaaccatattatatgtaccctgtttctgggatattttaagtttgtccaggagcacggtatcagccaggaagagattccggagctggtgaaccagttcattcaggagagtaaggaaatcacacagtgctatgcctatgattttcacccaaatagtgaatatacacaaaaaacatgacaaatttataacaaattgacgaaaaagacaattcctacagaaaataacaatagacgtcaagagttccattgattatcgcgataacttatgttatattatagacataagttatcgcgattactatttttaattatcatttttgcacaaaacccaaattttgtaactgaaagagtactgtcatggttgccaggtacgatatatgggaatatcatggacaatcaggcagtaaaatataaagaagtggaggtatttcatatgaagcttgaattgggaaaaatctttatcaaagatatccgattcgatgacaagactcacgtgaaagacggagtgctctatgtcaacaaagaggaagttgaaaagcttgtgctggaagacgataagctgaccggctgccacgttgacattgcaagaccaggtgagtccgtcaggattacaccggttaaggacgtgattgagccaagggttaaggtcagcggcggagagattttcccaggcgtgattgggaaggtaagccctcaggtgggtaccggaagaacacacgccctggaaggctgctgtgtagtgactgtcggtaaaatcgtaggattccaggagggcgttatcgacatgagcggccctgctgcagattactgcccattctcacagacttataacctctgcgtggtagtggagccggctgacggcctggaaacccatgtatatgagaaggctgcccgtatggcaggcttaaaggtagctgcttatgtaggcgaggcagcaagggaactggagccggatgaaatcgttacttatgagacaaagccaattttcgagcaggctgccatgtatccggaccttccaaaggtaggctacatccatatgctgcagtcacagggacttctgcatgatacatattattacggcgtggatgccaagcagttcatccccacctttatgtatccaacggaaatcatggacggcgctattgtttccggcaactgtgttgctccatgcgacaaggttaccacttaccatcatttccacaatccggttattgaggactgctacaagcaccatggcaaggatatcaactttatgggcgttatcctgaccaacgagaacgtattcctggctgacaaagagcgtcattccgatatggttgccaagctgtgcaactggatgggattagacggcgttctgattaccgaggagggatacggcaatcctgataccgacctgatgatgaactgccgcaaggtagagcgtgcaggaaccaaggttgttctgattaccgacgagttcccgggcaaggacggaaagtcccagtccctggcagacgtgtgcgaggaagctgatgcactggcatcctgcggacagggcaatgccacactccagttcccggccatggataaggtcatcggaacacaggacttcatcgagatgcagattggcggctgggacggctgtaagaacccggacggcagctttgaggcagagcttcagattatcatcgcctccaccattgccaatggtttcaacaagctggcagctagaggctattaatcgaaaataaaggagatggaaagatggctaaatataaaatagtacattatattaaccagttctttgccggaatcggcggtgaagaaaaagccgactatacccctgagcttcgggaaggggtcgtaggaccaggtatgggacttaaggctgcactgggagaggattatgaaatcgtatcaaccgttatctgcggtgacaactatttcggagagaatctggatgctgcaaccgataccatcattgagatggtaaagaaatgcgagcctgatgtattcgtggcaggccctgcgttcaatgcaggacgttacggcgttgcctgcggcaccatctgcaaggcagtggaagagcgtctgggcatcccggttatcaccggtatgtatattgagaatccgggcgtggatatgttccgcaaggaccttatcatcgtggaaacccctaactccgcagcaggtatgccaaaggtacttcctgttatgtccagcctgattaagaagatggcagagggcgcagaaatccttggaccgaaggaagagggatacattgagagaggaatccgtgtgaactacttcgctgagaagagaggttccgagcgcgctcttgagatgctggttaagaagttaaaaggcgaggaatatgatacagaccttcctatgcctaagtttgacagggtagcaccggctgagcctgttaaggatatcaggcatgcaaagattgctgtggttacctccggcggtattgtgccaacaggcaaccctgaccatatcgagtcctccaacgccaccaagtggggcaagtatgacattaccggtatggaccgtctgtcacccgatgagtttacaaccatccacggcggatatgaccgccagtttgctatggccaaccctaacgtggttgttccattagacgcattgagagagctggaaaaagcaggcgagttcggcgagcttgtgaactatttctgcgctactaccggtaccggaacagcaactgcatctgcagctaagttcggcagcgagattggacagatgttcattgatgagcatgtggatgcggtaatactggtctccacctgaggtacctgtactcgttgcggtgcaacgatggttaagggtatcgagaaatatggcattccggtagttcacatggctactgtagttccgatttcactgacaataggcgctaaccgtatcattcctggtataggcattccttatcctctgggcgatccgccacagggcgagaaggacagctataaactccgcttatccatggtcagaagagctctcaaagcacttcagacaccggttgatggccagactgtgtttgagaaataatcacagatatgacaaatccggcgcagcaggcagcttgcccgctgcgccggcataaattaagacagcgtttcagcgctgtatcagaccatggataggagaaggcgtatggatagtgataagaaagtcaactggggacgggtagttatacttgccggagcaatcatcgcgtttaccattggttccgggtttgcaacaggacaggagattgtccagtactatactgcatacggcgtgcagggaattctgacggtattactgtttgcggtctgcttcatttactataattataactttgccaaagccggagcagaagaacgttttgaaaaaggaaatgacgtatacaaattttactgcggtaaatacgttgggaccttcatggattattattctactatattctgttacatgtcatttttcgttatggttggaggtgctgcctctacactgcaccagcagtacggtcttcctcattgggtaggcggcgtggttctgacagcactggcaatccttaccgtggtagggggactcaactcgctggtcgacaagattggtgtggttggcccggctatcgttatactctgtatcggtatcggcgtggttaccctgttcaatgatgcaggaaatgtgggcgccgggctggaggttatccgtacaggtgcctttgccgaggcaggcagtgagactatcaagaacgcaggtcctaactgggtgatatcagccctgtcctatgcgggctttgtgctgttgtggttcgccagctttacagcggcattgggagcgaataataaaaagaaagacgtggagtatggcatctacggaggcactgttgccgtatgtgttgccattatccttatcatgctggcacaggttgccaatatcaatacacctggattaagcaattccggtatctttgtatggaatgccgatatccccaatctgattctggcagagcgtatctggaaaccatttgcatccttctttgcagtggttgtatttgctggtatttatacaaccgcagttccgctgctgtataatccatgcgcaaggttcgcaaaagagggaaccagccagtttaagcttctgaccgttgctcttggagtcattggactgattgtaggactcttccttcctttcagggtcctggtcaatattatctacgtgctcaacggatatgttggcgctgtactgatactgttcatgttgtggaaaaatattaaggatgtatttttaaagaagaaatagaatgagaatctatattgtggactgcgacaggaattcgcggacagaactgaaaaccatgattgaagacaacggtatgggaactgttgccggcattgcatccagatgggaggaagcctatctggaagtccaggagatgtgcccggatatgattctggcagaccttactctttctgcacccaaaaccattgcatacatacagaaaatcagagaggtactgccccagacatcggttgtcatcctttcgcatgtcaatgatatggatattgtcagtatggcttatgaaaaaggcgcggagcttttgattcataaaccgttcaatgcgacagaagtaaagaacgtactgcacaatatagaaatggccagggccatgcagtggctgattgtcaaggccaggaatgactttgccgcaggcgcattttcctgggaggcaaaggtgcagggacggaacatgcagcctgaagaacaggagccggattataaccagcctatacggcggttaaagggaatcctgcaggaaatcggtatactcagcgaggcggggagcaaggatatcatccgtattatccgctatctggttgaagaggacctggacttaagggacattacggtccgtgagctgtgcagcaggacgggacagaattccaagagtgtggaacagcggatacggcgcgcagcctctgccggtatggcgaatctggcatacagaggaatggatgattatgcagaccctgtgtttaatgaatacagcgccaggctttacagtctggaacaggttaaacgggaaatgagctatatcaggggcaagagcgacggacacggaaacgtaagagtcagaaaattcctcagcggcctgcttgtctgctgcaaggatatttagaaatgtttagaatgtaacagagtggaagggggcaggctgtccgctcccggtttgcaaagctgcaaagctgggaagacaggactgcctcctttttgttaaaattttatcaaatcaccatcaccggatgggaagacggaccgtccacatggcctatgacagccggggactggcaggccttctgaagggcttccataatgcgccctgcttcctggggcgccacactgtacaggaggccgccggaagtctgagggtcgaagagaaggtcgtgtacatgggaaggaaggtcctttggcagtgccacctttgccttaaggtgattcatgttctggtatgcaaccgcaggcacaagccccatggatgcataggtgtccgcaccggggagaagggggacgctgccgctgtctatgattacggtaagtccggattccccgcacatctcatagctgtggcccagcagtgagaatccggtcacatcggtgcaggcgtggacgccgtccaggctgcgcactgcatcggctgcatatttattcaacgtagccatacagtcaaccatggacttgtgttctgatgcagataaaaggccgccccggtcggcattggtcagaacgccggtgcccaggggtttggtgagaatcagcacgtcgccctgccggatagagttgttgcgcaggatgcggtccggatggaccaggccggagacgcacagaccatatttgggtacctcgtccttgatggtgtggccgcccactacaatggcctctgcctcagccaccttgtcatagccgccccggaggatggcctggaccgtgtcaaagggaaggtgttccggaaacatgaggatgttcatacacaatctggcttccccgcccatggcccatacgtcggacagggagttggcggcagcaatctggccgtactcatatgcatcatccacggccggcgggaagatgtccacggtctgtatcagggcaagctcaggtgtaagctggtagacggccgcatcgtcggaggtatcatatcccaccagaagccggtcatcatgaaatgttggcaaaccgcgcagaacctgcgcgagggtatcaggccctatcttggacgctcagccgccgcaggaacctgttagttcagtcagtttaatatcgctcatcagtgatactccttatcattggatgaaaattgatagctactaacttattatattatctgttttccaggttttgtcaaggacaaacgcggggaacccccctgtttttggagatggatataaagaaactatttaaccaaaagttatcgtgattacattaaggaggttaaaaatgattgatttgaccaaggaaaactttgaggaagaagtattgaaggcccagggctatgtgctggtagacttctatggggacggatgcgttccctgcgcagcccttatgcctcatatccacaagtttgaggaagtgtacggaacatccattaaattctgttccctgaacaccacaaaggccagacggcttgccattgcccagaaggtgctgggactgcctgtgattgctatttacaaagacggggaaatgattgattccagggtaaaggatgacgcgaccccggagggttgcgaggaaatgattaagaaatacgcctgatgacagacacggcccggacagccggatacaaatgatgcatgaccgctgatgcggctgatgtataaaagcagcgcttgaaagcgcaataaagaaaaggaggaacaatgtatggctatactgaaagacaagtatgcaatcatcatcggtgaccgcgacggcgtacccggaccagccatcgaagagtgtgccaagacagcaggcgcaaagatagcttactcttccacagagtgctttgtctgaacgtccgcaggtgccatggacctggaaaaccagaagagggttttaaacataagtgaggagcacggcccggagaacgtagtagttcttctgggagctgctgaagcagaggccgcaggccttgcagcagagaccgttacagccggcgacccaacttatgcaggtccattggcaggagtccagttgggactaagtgtatatcatatctgcgaggatgaagtaaaagctgagacagacccagctgtttatgaggagcaggtgggaatgatggagatggttatggatgttcctgccatccatgaagagatggaaggaatccgtaaggagtactgcaagtattagacaggaagaaaacaagtagaaaagagctgacagtccataggggctgccggctcttttttcggaatttttttatggatggatttactctgcatatggtaaatccacaactgtgtagggatggccaagggccggaagaatcttttccagcaggtccgaggttttgaatttcaggctggatgtgttgatgcatggatgacatgcaaaatattcttcttccaggatatctttgtcaatcagcagtctgacacgtttttcgctgtcgttcatcaggcccatgactgaaacagaaccgggagtgatgtccaggaaggattccatgaattccgcttccccgaaggacaggcgggcgcttccaatctgtttggacagaacggctgtcttgaactttttattgcctggcatgagcagcaggtagaaatcggttttctgggcattgcgcaggaacagattcttgcagatttccgtacccagaagctggtccacctcgcggcaggcttcaatggtgggaagggcgtcgtggtccacgcgcacaaagggaacgtggagggaatccagtaaatcgtaggtgcggatttccttgtcctcacggccggatgcgtcggcgggacggccctcataaagggtatggtcaatatggtatgtggggatggactccccgttatcgttaggatttgtcatttctttacctctgttttattgttggtgtgttggatgtgaatgcgattaaaacatctcaattatagcaaatagggcggggaatgtccatagatggaactgctgattacgggggttatgggcttttgcagttactgttcagaggtatcataaatcagtatcggcaaagtgacgaaatttaaaatttaagaaatagcgtattttgtggctatgtctatacggagctgactaatactaatcggtcgagggcttatccaaaaaggttaagggaaagtggtttgtggaacaatcggaattcaatatgtggttttgagggtacgtaaaatgttatatttgtgcttgaaattttgacaaagttattgtataatgatttggtcagcgcaaagtacaataagcgtatcattattcctcgatagctcagtcggtagagcacgcggctgttaaccgcgctgtcgtaggttcaagtcctactcggggagttttagtggaagtccatggcgaccactaccttattcaggccccatggtcaagcggttaagacatcgccctttcacggcggtaacacgagttcgaatctcgttggggtcatttgaccagtttagatacgccgatgtggctcaattggcagagcagctgatttgtaatcagcaggttatcggttcgagtccgatcatcggcttttactgtaaaacagtaagcaatgttagtgattatatagttcggacctttagctcagttggttagagcaaccggctcataaccggtcggtcctgggttcgagtccccgaaggtccactcttcctaactaaagcagaatgagaactatatcatctaaataatggcccggtggctcagctggttagagcgccgccctgtcacggcggaggtcgacggttcgaacccgttccgggtcgtttttctttcatatatacgctgaaagagatacctattggggtcttagctcagctgggagagcatctgccttacaagcagagggtcacaggttcgagccctgtaggccccatttgttttatatctgcatatggctttgtcatatatcaatctgcgggtgtggtggaataggcagacacaagggacttaaaatccctcggtagcgataccgtgccggttcaagtccggccacccgcattttttatatttgcggctgtggtggaattggcagacacgatgggtttaggtcccattgggaaaccgtgcaggttcgagtcctgttagccgcatacgtaagagtcctgtgtttacagggctttttttgtttccggaggagctgcgcggttccagggaaacttatgagtgcagcaaacagacccgatggtatcgggtccggccactcttcgctttctgtgattttgtaaattatgtcctggcaataagcagacggacaccctaaacacattttacaaaaatcagtcgtagtagtgttccacaacatagtgagagagcgcatctatgaaggcgccatttcgcggcttctgttccaaattgaagccaaagacctgatttaagaggttccggtctccatgggcccatatggtgctgataatggtgcggatattccgttccacacagccagtggatgtatggtattccgcagaaatttccacataaagtcctttggatatgtagattagcagttccagattggcaattgcgcggatgataccataaactgtatagcggaaccccacataggagttgttgacgccgaggcgccggagcaggttacaggtttctctttcgtatttcatgatgattcctcccgatatcagttgactcctgtaaagttaaaccggggatgggggttttatcaagtaagacaagacgacaaaaaacgctaaattatgtcgctaaatgtcgaaggattagccggggaaaatcagggggaagatagtaggggataaagggagtagtggatataactgagtatagcaaaagtaagggcttaaagctatctcttatggcagcagcggccggcctttatattcttgtatttgaccggaaacagcagtataatattctgtaatcggtagaaggagaccaggcaaaggggggtaagcctatgtttcttctgtttttttcagtgtggttgattttaaacggcaaggtgacagcagaaatctgcgtatttggcgttgtaatttcagccgcacttttttattttatgtgcagattcatggaatacagcatgaggaaggaattactgctcttcaaactgattcctctgtttgtcagatatttctgggtgctggtcaaggaaattgtcagggccaatgtgtgtgtacttaaaattatcctttcgccggagctgcagccggagcctgcctttgtatattttgaaacagctctcagaaccggactggccaaggttatgctggctaattccataaccctgacacctggaaccataaccgtatcagtggagggaaaccgtttctgcgtccattgcctggaccgggaactggctgagggaatggaagagtccgtatttgtggaactgctggaggaaatggaggcggaggaagagagatggaggtaatcgaacaggtgtatgatattcttctggccgcggccgtcattgtgctggctctgttaatcattgtcagtatggtccgttctgtcctgggaccgggaattgcggaccggattattgctgttaatatgacagggaccatgattatcatgattatcgcaattctgtccgtgtatctggatgagaattatctggtggatgtctgcctgatttatgccatgctcagttttctgggggtagtggttctgtgcaaggtctatacaggcgtttatctgcagcataagaaaatgaaagcagacttggatgccattgacgataatctgaaacatcagtctgaagggcaggaggacaggctgtgtaaaaaggaggagggagatatatgacggtgcaatggctaaaattatcattatctgcatcctttctgtttatcggtatcctgtttatggtgctgtcggttttcggggtcaaccgctttcacaaggctctgaaccggatgcatgcagcggcaatgggagataccctgggaattctgtttgtgtttatcggtctgatagtcatgaggggaatttccatggattccctgaagctgtttctggtcatcctgtttttctggacagcaggacctgtatcgggccatatgattagccggctggaggcaatgacggacgaggatttgggggaaatacttgtaatcgataaatcccatccaaaagacccagatgaaagcggggacaaagcatgagaatatttgaaattattttattggtctgccttattgtgtgtgcggtatctgttgcgtttgcaaaggaccttctgacctccatcatcatttttatgtcatacagcctgattatgtgcgttatctggattctgctccagtcaccggatttagccattacagaggcagcggtgggggcgggggtaacgagtattctgtttttcataaccttgaagaaaataaaggcaatccgcagggaggaacgggatgagcaggagaagggatgattatgaaagaagccggtggctgaggttcagaaaatgggtggataagggggcggacctccttgcagacgggatagagattcaggttccggaccaggatgctgttttgcccatggaggcttatacagaacaggagttccggcagaccagggaaaaacaggaaacggcagaggataagggaagcctttcccaggaacggggaatccgcgtcttccgcaggttttatcaggtgatgtccgtgctgctctgtttcagtattatatttgtcctgctgtggaccattgcctaccttcccgtgttcggcaatgcgggcaatccggataataatgaggtctcgtcacgctatataacagaaggactcagagagacaggggcagtgaatatggtgactggcatgattctggattacagggcctttgatacatttggagagtcctgtgtcctgtttatagcttcctgctgtgtgtttgctcttttgaggattgatgcggcaaacagggataaggacacaagaaagcgcctggaggaggccaacgacaggctgtttgaaccaaaaaacgatatcattctgcagaaatgtgcctgtgtgctggtgccgcttatcataatattcggcatatatattgtgctgaacggccatctgtcgccgggaggagggttctccggaggagcggtcctggggtccggactgatactttatctcaatgcctttggatttcggaaaaccgaatgtttctttacggaaaaggtgtaccgcaggactacccttggagcgctcaccttttactgtctggcaaagagttattcgtttttcaccggagccaaccatatggacagcggcattcctttgggcacgccgggtacaatactcagcagcggccttattctgccccttaacatctgcgtgggcctggtggtggcatgtaccatgtatgcgttttatacactgttccggaaagggggaatgtaggatggcaggtcatttgctgcttaatatagaggaaacggtttcggtcatcctgtttggcgtggggttcaccatgctgctgcttcaccggaacctgataaaaaaaattatgggaatgaatatcatggacacggcagtctatttgtttctggccgccaagggatacataagggggcgcatggttcccattgtggcggatgggattaccaatacagaggcatacatcaatccggttcccagcggactggtgcttaccggtatcgttgtttctgtcagcaccacggccctgatgctggccctgaccatacggctgtatgaacggtatgggtccctggacctggatgaaatcctgatgcatgcaaagcaggaggaaaagacatgagcctggtgcagaatttcccgttcttttccattatcatagccatgttctccggcattctgtctctggcattgtcaggaaaacaggccaggaacctgagtgttgcagcgattctttcggtaacggtcatgtccggggctgtgatggcatcctgcatgggtacgggagagagctatacctatatgatgggacattttcctgcgccctggggaaatgaaatcagggcaggggtgctggaggggcttacggccatgatgttcggcgtagtgatgctgctgtccgttatggggggattggaccacacttatgaggatgtggaaggtacaaagctgaacctgtttttcattatgattgatttgatgctcagttccctgctggctcttatttatacgaatgatttgtttacagcgtatgtatttgtggaaattaacaccattgccgggtgcggacttatcatgatacggcagaagggccggagcctgtcggctgccatccgctatatgattatgagccagctgggttcaggactgttcctcataggtttaagcctgctctacgacgtcacgggccatcttcttatgagtcctgcaaaggcggctgtggcacagattgaggcagcgggagtctatgggattcccatgctggtcatactggctgttatcagcgtgggcctggccattaaaagcggcctgtatccgtttcactactggattccggatacatacgggtatgcaacgcctactgccagcgctgtcctgtccggtctggtgtcaaagggatatatatttctgctgattaagattttttaccgggttcttggacgggaaaatgtaattgccagccagattgtgaatgtgctctatgtattcggtctggcggggatgataatggggtctgtccatgccatcgcggagtcagataccagaaggatgatagcctactcttcggtggcgcagattggctatatctatatgggaatcggcctgggaacccaggccggaatggtggcggccatattccatatgtttacccactcagccaccaaggccctgctgtttatcagcgccgtggggctttatgaggtgtcaggcggcaggaaggattacaggagcctgaggggagcgggctacagggcgcctctggcgggcatgggctttgccgtgggttccctgtccatggtaggatttcccatgctggcgggatttatttccaagctgctgtttgccacatcggctcttcagagccctcataagatgattcccacattgattgccctggctgtgagcactacgctcaacgcaatatatttccttcgtctggttatcaccttatattccagaggagagagaagcagccggagggcgggaagctcatggaagctgcgggcagctgttttatgctttatactgctcaacctggcactggggctcaagtcccagccagtggtcctggccattgagaacggacttgccatgtttgattaaaaggagacggactatatggaaggaaatgtgatgttattgctgccaatactggtccccgtggttgtgggcgcgctggtattgtccgtgaaaggactgagaagggaccggaggattctcatggggattgtgaccggtactttggccgcaggatgtatccttacattctgggccctgtataagggaggacagctggcggtgtggcggctgtcccaatccattaccattggtctgtccgtggatggggttagcaggatttttgccgcccttacctgtgtggtctggctgctggccggaatatattctgtctcctatatggtccatgaaaaggacgagttccgttttttcggattttatctgattgtgctgggagttctcatagggctggacttttccgcaaacctggtgactctgtatgtgttttttgagatgatgacactgacctcccttcctctggtgcttcatgagatgacaagggaggcagtgatggcagggcttaagtatttgttttattcagtggcaggtgcgtttcttgccctgttcggtatttttttcctggcggggacagccgttacccttacctttaccccgggaggcgtggcatttaaggattccctggcggggaatgaggggatgcttctggtttcagtctgctgtgtcctcattggttttggaacaaaggccggcatgttccccatgcacggctggcttccaaccgcccatccagtggccccggcgccggccagcgccgtgctgtccggcctgataaccaaggccggggtgctggccatcctgcgggtggtgtattttatcgtgggaccggaccggcttaagggaacctgggtccaggatgtgtggatgttcctttccctggcaaccgtattcatggggtccatgctggcctacatggaacctgtgcttaaaaaacgtctggcgtattcaacggtgagccaggtatcctatattctgtttggtctgggcctcatggttcctgcgggctttgtgggagccctggcacatgtggtatttcattcccttattaagaatgccctgttcctggcagcaggcgcaatcattgttcagaccggatataccagggttaaggatatggggggattgggcaggaggatgcctgtcatgatggggtgctacaccgtggtatccctggctctgataggcattccgccagccagcggctttgtgagcaaatggtatctggcctccggcgcattgtcctcagggctggcaggatggtccgtggcaggtcctgcggttttgctggtaagcgctctgctgacagcgggatatctgctgcctcttaccattaacggtttttttccggcagtggaaccagcggcggaagcagggagggaatctgtggagggtgagccatatacggagacagccatgggcgcagagccttcccggctcatgctggttcccatgctggcgctgacagcaggagcccttcttttcggatgtttcccaggtcctcttctgtctgcgctggaatccatagcggcagcggttctttaagggaggaaaggatatgaacagtatggtattggcagttcctgcccttcttcccataggagggggaatactgcttctgatagtcagacattttcccatgaaggctgaaagcagtaaggatggcgcctaccgcaggctggagttcctgacaggaggcattaccctggcaaacagtttgatggtagggtggcttattgctgcaaagtcaggcacaggggaacaggcagtgctgttccgtctttacggggatttgaaggtcatgttctgcctggacggcctggggagtgtctttgcagggctgattgcccttctgtggcctcttgcggtgctgtattcttttgagtatatgaggcatgaggagcgcaggacctctttttttgcatactatctcatgacatacggcgtgaccgtgggaatcgctttttccggtaatctgatgacgctgtacctgttttatgagctgctgacccttgtaacctttccgctggtgcttcatcccatgaccagggaggctgccagggccagcaggaaatatctgtactatgccattggaggagctgcctttgcatttattggaatcattttcgtgctgagctattctgcatccggtaatacgcagttcatgcccgggggcgtgctggacctgacagcggtccgggagagaagaggtacgctgcttttggtgtatgtgctggcttttttcgggtttggtgtgaaggcagccctgtttccctgccatggatggcttcccgaggcaaccgtcgcccccacgccggtgacggcgctgcttcatgcggtggcagtggtgaagtccggtgcatttgctgttatacggcttacttattttagctttggaacgcaatttctaaggggtacctgggcccatatggcggtcatggccgcagtgatggtgaccattgtgttcggctctaccatggctgtaaaggaaatacactggaagcggcggctggcctattccacaatcagcaatctgtcctacatccttctgggaaccgtaatgatgagcccgctgggactggccgcggccctgagccacatggtgttccatgctttcatgaagatatgctcctttttctgcgccggctgtgtgatgcatcagtccggcaggacctatgtatatgagctggacgggctgggacggtacatgcctgtgacattcggatgtctgactgtggccagcttttcactggctggaatacctccgtttgcgggattcgtcagcaaatggaacatagcccaggcagcctttggctgcggggcggacctggcagctgccggcagcagcgggaaatggcttgcttatgcaggggcgggtgtgcttctgtattctgcgttcatgacagcggtgtatatgtttacggtgttggtcagggcctattttcctaaggcggacgggccggaacagaccccaaagtttgaaagcgcattacaggaaatacgggaccctggctggatgatgctggcgcctctggtcatatttgctgcggcaatcatcgggctgggcctgtactcagggccggtgatggagatatttacagagatagggaggatggcgggatgattgagacaatggacctggtgctcccgggaatctgcggcctgggaatccattttcggctggatgggttccgtctggtctatgtactgattgcggttatcatgtggacctgctgcgggctgttttctaaggagtatatggagcattacaggaaccggagaacgtactatgcttttttctggattacattcctggccacggcgggcgtgtttttgtctgcggatttatactctgtctttatattctttgaaatcatgtcctttacctcctatgtgtgggtggcgtttgacggcaggagggagagcctgagggctgcgaacacgtatctggcggttgcggtaataggcggtctggtgatgctgatgggattattcctgctccatgacctgttagggacactggaaatggatgctctggaacaggctgttaaaatagccggggacacagggaatcaatggaggctgtatggggccggaggaatgcttttgtttgggtttggagcaaaggcaggatgtttcccgcttcatatctggcttcccaaggcccatccggtggcccctgctccggccagtgccctgctctccggtatactgacaaaggcaggggtatttggcgtcattgctgtctcctgcggtatctttggttcggacggggcctgggggcttctggttactgctctggggctggcgaccatgttcctgggagcgttgctggcgcttttttccgttaacctgaaacggacgctggcctgttcctctgtgtcccagattggttttatctttaccgggattgggatgtcctgcctgctgagggcagctgggcgggatgatttcctggctgtcaggggcgcattcctgcacatggtaaaccattcccttttaaagctggtactgtttttgagcgcaggcgctgtattcatgaacctgcatcagctgaatctcaatgatatcaggggattcggaaggaaaaagccctgtctgtgcttctgttttctgatgggagccctgggaatcagcggaatcccttttggaaatggatatgtgagcaagaccctgctgcatgagggaatcctggaatatatagaggctgtaagggaaggggcagcggtcccgatgacatcagcaggcccatgggaatggcccgcggtacggtatatactgactgaaccgggaatatggaaggcagctgagtggctgttccttatcacgggaggcatgaccctggcctatatggccaagctgtttgtggcgctgttcgtggagcggcatcccaccaggcagaaagaatttgatgatatgaagggaagctatatgggccgcataagccggctggcgctggtggttccgtctgctgccctgccggtcttggggctggtcccccatatttttatggattacctggcggacctgggacagggatttttccatgcagacataccggtgcatctggtgtcctatttttccagggggaatctgaagggagcaatgatatccattggcatcggtctggcgctgtacggtgcgggggtcaggggatttcttatgaagcgtgaaaatggagtgaacgcaaccagggattatgtggaccgctggccggcatggctggatttggaagagctggtgtaccgccctgtgattcagactttgcttcctgctgtgtgcggcgctgtatgcagggccgcggaccgatatctgctgtccacaatggttgcggtgctgctggccgtgtctgcggtggtctgccgggcaatggactgtctgggggacagccttatccggctggccagaaaaaccactcacaggcagagggatggaagcaggagagagcagggcggggacaggattgccgttgtgctgggaaggaccatagacaggctggggtccctggaacggctggctcccggaaggagccagcggcgcagggaatctgtgataccagggctgatgaaggccgaggaagaagttaaacgcaccggacggctggtggaggagagcttttcctttggactgatgcttttctgtattgggctgtgcctgacactggggtatttactggttgtgttttttaggggatgaacaccccagtatccgtatggtcataacataactgcggctgtctcccgggcagaggtgctgtatgtggtgtctgtgggagagctggtcgtcctcattctcatagatgccggagccgttccagggttccacgcagagatagggggccggtttcggatacagggtccagaaggcaacggtttcaaagcctgggaatcccacctccacgccgcggccggtggcgggattgaggatggataccttccgtgaatttagtttgtcaaagaacagggcatcatgtttaaacatttcccggtttaaggggaggctgctgcccttcagcggaatgcctggtttggaaggcgcaaagtgcagctgctccaaatcatagggaatactgaccgtatcttcttcttgttcaaattccagccagtaatcctcaaatgcaaatccttcctccatggggcagttaaatcccggatgagccccaatagcataccacatggcgcgccggtctttattttttacctgatattccatggaaagcatgccgtccttcagttcatatgtcagggaaagacagaaggcgtaggggtatacacggtgtgtgtcaggagtgtcctccatggtgaaaactgcttttgccggagagacttgtgacacatcaaagtcatgttcacggcagaagccgtgtttctcaatggcgtatatgcggtcttccaggatagtcctgtcgttccggcagttgcctaccacgggaaacaggaggggggagcatttgccccagtattccgggtggcgctgccagatatattcatggccggaaacatccttcagggaaatgagctgggctcctgtggagtctatgacagccgctgtcttggaatccttgattgtaatcagcatggtgtattcctcttttctttttgttatttatggcagaactgttttgcaccggagtatgtttgaaaaacctagagcccgtgttcgtgtcaggcgtcttcctgctttgggctgtagggggcgcagctttccctgttagccagatagaagggaaggttcattttgatgggcagcttatggccttcctcaatccggtcaatgaggatttttgctgtcatctgtcccatttcttccaccggtatatggatggtggtaagcatgggcgagagatactgggccgtgtctatgtcgtcgatgctgatgacggacaggtcgtcaggaatcaccagcccggcttccttgatggctctcatggctccgatggccgtattgtcattgcagcagaatacggcagttatatctgtcctgcgggacagaagttccttggcccccttgtatcctccctcggaggaaaggggaacattgacgatgtgggattttgccgggcgcagattgtgggcgctcagggccgcgcagtagccggtgtacctgtcctcaaactgtgtttctccgataaaggcaattcttgtatggcccaggccgatgagggtattcatggcagcaaggctggcctggtatccgtcgcagattatctggtcgtatttggcctccagcagattgagcccggtgtaggccacgcagttaaagtatttctttaaaaagctcagggtctgtttgtcgcaccgccccaggaccaccacgccgtccacatgattatctgtgatgagccggaatgtattgggatggtgtatgtcgatggcagtgaaggagtattttaacacgtagttgtgcttgaacgcttccttctcaatgctgcgggccagcgtggagaaaaacaggtctgagttggagtcctcagctcttgcatacaggcaggcaatggaccgggtgggagagtcggccgcttttgcagcccctgttttcagactgcgggccgtggcatttggggtatagccggtgcgccggactatttcccagatgcggtcctggacttccttgctggcaacattggtgctgtttttgtttatgacccgggagacggtggagatggatacccctgcttcccgggcgatttcttttaatgtcatggcaaccctccttttctggggtttttcaagcaaatttctgaatctgtttactttaagtatacaaaaaaaggcctgggattactataaaataatacacaaacgtttgcgtaaaaaactgtggacgaaagtggaggaaaaccgtggataaaggctggtatatcaacggttttttgagattctccggtacgcaaacgtttggtttgaattgccttgccttggcatagtcatattgctataatgactttgcaagttgggtgataaatagtcaaaaatagacgtaacacggttgctccgtattattttagcggtataaatgttaatcatttaacaaaaacaaggaaaaaaatatgcaactttcataagagggtaaaggcggctgtttattacgcaaagcatgtagcaaaaataagagaaccatttggggacaggaggtcaaacgttatgagaaaatcattagtaaagacattggcagtgacaatggcagcagttatgtgtgccgggatggcagcaggctgcggagcaggttccgaaaccaagaaggcggatacacagacacaggcgtcgggagcaggagacagtaaggcagcggacaagagctatgagctgaccgtgtcgggtataggaggcagccttaattatctgcccatctatattgcggagcaggaaggctggtttaaggaaaagggactggatattgaggaagtgctgtttaccaacgggccggtacagatggaatccctttcatccgacggctgggatattggctgcaccggagtgggcggcgtgtttgcaggtgttctgggatacgatgcgctggttcttggctccagcaatacggacgacggaacacagtatgtatttgccagaaatgattcggatattgtaaaggcgggcaagggacacagcagcctgagcgatgagatttacggggatgcggacagctggaagggaaaatccatcctgtgcaataccggcagtgttacacagtatgtgctgattaaggtactggaaggcttcgggcttacggttgacgacgtaaactttatcgccatggacccggccacagcttacagcgcatttctggcaggcgagggagacgtgtgtgtgctgaccgggtcgggcggtacctttaagatgctggctgagtctgataagtatacgcctgtcgccagcggccccatggctgattccggactgatgtgcagctttgtggctaataagaacagttatgctgacccggataagtacgaggctatgaaggtgttcatggaagtatactttaataccctggactggatgaaggaaaacaaggaaaaggccattgactactgcgtggacatgaacgatgaaaacggaagctccatggacagggaaaccactgccaagtatctggaggctgatacatattacaccctgcaggaggcatgcgatatgctgaataacaaggcagagggttccgacaatacagttatggaccagagacttctggacgtgcttgatttctttatcagcgtgggcaattacaaggaaggcgaccaggagagattcgtgggacatacggatggaaagctgttaaatgaggtactgactgaaaccgcaaattaaaaaggagctgagataccgatatggcaactggaaatgagaaattagaggctggccttttggagtggaaaaagcagaaatcaaaggaaggcctgaattacgccctgttaagcgcggcaggaatcatcactctgctggccgtgtggcagctggtagtaagcgtgggtcttgtgaatgagaggatgcttccggcacccacccagatttttgagaccctgatgtataagtttgcgaataaggccccggacggcaacgtcctgtgggtgaatatactggccagcctccaggttgccttatccggtttcctggcagccatcataatcggcgttccgctgggactggtcatgggctggtggacctatgcggaccgttttatccgccccatctttgagctggtgaggccggttccccccattgcctggatacccttggtagtggtgtggatgggaatcggcctgaaggcaaaggcgctcatcatcttttttaccgcctttgtgccctgtgtcatcaattcctacacaggcataaagctgaccaacaagactctgattaatgtatccaggacctttggggcctccaacgcggagatattctggaaagtgggtgtaccttcctcccttcccatggtatttgccggaatccgcgtggcattgggaaattcctggtccaccctggtggcggcagagatgctggcagccagcgccggactgggatacatgattcagattggccgtacagtggcccgcccggatattgtaatcgtgggtatggtggtgattggcgccatcggagccattctttcaggatttttgtccagggcagaaaaatatttcctgcgctggaaggtaaacaggtaggagggagtaaggaatatggatgtagcaagcaaacagcagaaaacattgagaaacgtcctgtactacggcctgcctgtattggcaatcctgatgattgccgtgggatgggtcctgttctcggacagccacccggagctgatgcctgccccggctgatgtgtgggcgcgttttgtgaagacttttaccaaacccatcgcaaagacttccctggcaggccatgcatgggccagcttaaggcgtgtgctgatggcgcttcttattgcatgggcttttggtatttcctttggcattctcattggatggaacaggaaatgcaaggcgtttttcggcagtatatttgaggttatccgtcccataccgcccattgcctggattcccattgtaatcatgtggttcggcatcggtgaattcccaaaggtgctgctggtatttatcggaacctttgtgcctctggtcatcaacacttccacgggaattgagatggtggataaaatcaatttggatgtaggccatgtatttggcggaaacaacaggcagatactgacggatatcgttatccccactgccctgccctccatctttgcgggaatccgcacctcggtcagctcaggctggacaacggtactggcggccgagatgttaggcgcccagaaaggactgggagcactggtgaccagaggctggcagggaagcgatatggccctggtacttgtctctgtcataaccattgcaatcattggcgcccttttgtcactggggcttcaaaaacttgagaaggtggtgtgcccgtggaacaactaaacagacgaatggagataaaaggaatatccaagacatttttcagtgagaagggatattttacagccataaaagatgtgagctttgatgtgaatgacggcgagtttctggttatactgggaccggggcggtgcggcaagaccgtgctgctcaatatcattgcgggactggagcagcagaccgggggaaagattgtgtacaatggcagggagtggaagggcgtgaacccggaaatcagcatggtattccagaagctggccctgatgccctttaagacggttatggaaaatgtggagctgggccttaaattccggggaatgtccaggggacaacgcagagagattgcacagcattacatagagctggtgggccttaagggatttgagaaatcctatcccacccagctgtcaggtggcatgaaacagagggtggggattgccagggcttatgcggcggaccccaagctgttaatcatggacgaaccctttgggcagctggacgcccagacacggtatcagatgcaggaggaaatccttagaatctgggaaaaggaaaagcgcaccgtcatatttgtcaccaacaatatagaggaagcctgctatctgggagacagaatcatcctgctcagcgactgcccggccactgtgaaggaagtatatcccatcagcattcccaggccaagggatatggtaagcgaggagttcttaaaactgcgtacggttatttccgacaacactgatttagcaatttaatggtataggaggacaaaaatgcctgaaagagaggacacccggcccgttaaagttgaggtcaggaatcttacaaagcgcttcggcgacctgctggtgctggacaatatgtcatttaacatccgtaaaggcgagttcgtgtgtgtcgtagggcccacaggctgcggaaagaccacatttttaaactgtcttaccaggattcacatgcccagtgagggcgacttgtatatagacggggtccctgcggacccgcgcaagcataacatttcctttgtgttccaggagcccagcgcccttccgtggctgaccgtggaggagaacctggcctatgggcttaagattaagagaatccccaaggctgaaatcgaccgcagggtggaccagatactggacctgatgggacttcaggagttcaggaaggcgtatccgggggagctgtccgtgtcagcggagcagagaatcatcatcggacgttcctttgccatgcagccggacctgctgctgatggatgagccttacggacagatggatgttaagatgcgtttttatctggaggatgaggtcatacgcctgtggaaggagctggggagcacggtggtgttcatcacccacaacatagaggaagccgtgtatctggcggagcgtgtgctgattctcagcaacaaaccggccaaaatcaaggaggaagtgagaattgacctgccaaggcccagagatatcacatcctccaggtttatcgagtaccgcaactatataacagacaagattaaatggtggtagaaatatggaatcaggacgattaaatggaaagacagccattgttacaggcggggccagaggcattgggtttgggattgcttccagatatgcccgcgagggagccagggtggtcatagcggatgtgctggaggaagagggtaggaaggctgccatggacataggccatatggcggagttttatcagattaatctgcgggacagagcgcagatattttccatggcggattatgtacatgaaaaatacggacatattgatgtgctggtaaactgcgccggcgtggcccgtccatgtcccacgctcaaactgtcggaggaagtgctggatgaggtaatcgacatcaatatgaaggcgccgctgttctgctgtcaggcagtgggggcttatatgagacgggacgggggaggaagcattgtcaatatctcctccggcaataccagaatgattaacgtgggccgggtgccctatggcattacaaagggagcggtgaatctgctgacagagcagctgggcgcagaatgggccatgtacaacattaaggtgaatgccattgcaccgggctggattcggacagagatggttgaaagaccccttaaatccggaatattggatgagaaggccatattgtctgtgtcgcccatcgggcgtttcggaaaggccgaggagattgccggcctggcctgttttctggccagtaaagaatcagattacattgtggggcaggtgatatttgctgacggaggctggtctctgggcatcatgcccaatgcgcttgattatatcagagaaaatgaggaggattgaaatcatgaaggtattatgtctgccggagccaggaaacctggtgttaaaggatatgcccatgcccgaactcagggaggggcaggcaatcataaagatggaaatgtgcggaatctgcggttcggatgtgactgcttacaggggagtaaatcccaccatgcgctatcccattaacggactgggccatgagggagtgggcgttatccaggaaatcggggaaaatgacaagggcttaaagccgggtgaccgtgtggccctggaaccctatgtcccctgcaataagtgccacatgtgcgcggcagggcgttttaacaactgcgcggacctccatgtgtgcggcgttcataaggacggtatgatgtcccagtatttccttcacccggtacagcttttatataagcttcccgatgaactgaccttcacccatgcagccctggtggaacccctgaccatcggtcttcacggggcaaccagggccagggtgtcaaagggagagcactgcgttgtgttcggcgcaggaatcatcggccttatggctgcatttgcctgcatcaactacggagcaacccctattctggtggatgtgctgcaaaagcgcctggattatgcaaaggagctgggagtaccctgcaccttcaattccacggacaaacatgtggaggaatatctgcgggaggtgaccggcggcaagctgcctgaggccatgattgattgtacgggtgctcctgtgattctggagaacatgcacaattacgtgtgccacggggggaggattgccctggtgggatggcctcatgacccggtgcggattaacacggtacgcctgatgcagaaggaaattgatgtgtgcccgtccagaaattccaatgcaaaattcccggaggccattggtctggtcaaccagggaaaggtgcctacggacgccattatcacaaaaatcattgagctggaccaggtggaggataccataaaggatatgattcagtctccgtccgattatctgaaagttatcgtgaacatctgaaaaggagaataacatgctgacaaccacttatgaaatgcttcaaaaggcatatgaaggccgctatgcagttcccgccatcaatacccagggaggaacctatgacatcatacgggccgtgtgcatggctgcagaggagcttcgttccccggtcatactggcccactatgtgaatacaggagcctattcaggccatgactggttttacgagacagcaaaatggatggcccggaaggtttcagtgccggttgcaatccatctggaccacggggacagctttgagcgctgcatggagatgctgaagctgggatttacctccattatgtttgacggttcctccctgcctgtggaggaaaatgcagcagccacagaggaagtggccagggtgtgcaggaccttcggggtaccgctggaggcggaaatcggagagctgtgccgcctggatgacaagggaaataaaatgggcgcatccaacattgcggacccggatgtggtgaagcagtatctcaggctgtgccgcccggattcactggccatcggcattggaaacgcccacgggttttacaacggacctgtggatatccgggtagaggtgctggaggaatgcaggaagtttacggatattccctttgttcttcacggctgtaccggcatggacgaggaattggtcaagcgttccattgacagcggagtggcaaaaatcaatttcggcacccaggtgcgctgccggtatgtggaatatctgaaggaagggctggctgagggaaaagaccagggccatgcatggaaattatcgcagtatgcggagctgcggctgcgcgaagacataaaagacatcatccggctggcaggctcccaggataaggcgtgacacggtacggaatgaaaccttggaaaaggaaggtatgctatgacattgattccattaagacctcttatggaggcttctgttaaacatgggtttgcccagggggcatttaatgtgaacgcggtagcccaggcaaaggctgccatcgaagtacacagtatgttccgctccgcggccatcctgcagggagcggacctggcaaacggcttcatggggggaagatgcgactttatgaatgccaccctggaggataagaaagccggcgccgggaatattgccagggccgttaagaaatatggggaggacagccccatccccattgtccttcacctggaccatggacgtgattttgactcctgtgcagccgccatacaggggggatatacttcggtgatgattgacgggtcgtccctggcctttgatgagaatgtggaactgacccgcgaggtggtaaaatacgcacatgcaaggggcgtcagtgtggaaggggagctgggtgtgctggccggagtggaggaccaggtgttttcacagggctccacgtataccaaccctttaaaggcagtggagtttttccggaagaccggcgtggatgcactggctatatcctacggcactatgcacggtgcttccaagggaaaggatgtaaagctgcgcaaggagattgcggtggcaatccgggaatgcctgaaccatgagggaatctttggggccctggtgtcccatggctcatccacggttccccagtatattgtggatgaaatcaatgagctgggaggcacattgaccggtacctatggaatcgccatagaggaacttaaggcagcggccagatgcggcatcaacaagattaatgtggatacggatatccggctggcggttacccgcaatatgaaagaattttttgcctgcaacccggataagagaaacagcagctccatcggaggcatctatgagctgctggaatccaagcgggagcagttcgaccccagggttttcctgacgcccatcatggaaaccgtgatgaccggcgccataccggatgaggatacggcggccattacagactgcattgagcggggcgtgaaggaagtggtgggcacccttatcgtacagtttggctcttacggcaaagcgcctttggtggaacaggtttccctggaggaaatggctgaccggtataggaaaatgcaggtattataaatgggaaaggtggtagaggcaatgtctgcaaatgttctggtggtccatggaggcggccccacggctgtcatcaatgcttccctgtatggtgttgtggaggaagccaggaattccggcagcataggcaaggtgtacggcgcaatcggcggaagtgaggggattctgaaggagcagtttctggatttgatgcagtatccggaggaaaagctaaggcttctgctccagacgccggccacggcaatcggttcatccaggtatgccctggaacagaaagactatgacgccatggcaggaatcttcaaaaagtacggaatccgttatgtgcttctgaacggggggaacgggaccatggatacctgcggccgcatctttgaggcgtgcaggggagaggacatctatgtggttggaatccccaagaccattgacaacgatattgccataacagaccatacgccgggatatggaagcgcggccaggttcatcgctgcttccgcggcagaggttggggcggatgtcagggccctgcccatccatgtgtgtgtcatggaggccatggggcgcaatgccggatggattacggctgcatctgccctggccagaaagaagccgggggatgcgccccatctgatttatctgccggagcgccccttccatgaagaggaattcctggaggatgtaaaacgcctttacgaagaaaagggaggcgtggtggtggttgccagcgaaggactgaagaatgacagcggagaacctattgtgcctcctattttcaaggttgggagggctacctattatggggatgtcagcgcttatctggcgaatctggtcatacagaagctgggaatcaaggccagaagcgaaaagcccggcctttgcggaagggcatccatagcctggcagtcgccggtggaccgtgacgaagcagtcctggccggaagggaggcgctgcgggcggccatggagggcatgagcggcgtcatgattggccttatacgggatgaaaatgaggatggagagtacggcgtccgcaccgcggccattcccatcaaagaggtgatgctgcatgaacgggtgctgccggatgattacataaatgacaggggaaatgatgtgacggacgcattcctgaaatggtgcaggcccctcatcggacctgaattaagggagtttgtggactttaaagaagagtatgaaaagatgggagtgggagaatgaaacacatatttctgaacctgaaacggttcgatatacccagggaatacggaggggtcaacagtgttgcgcccatggaggaatgggggagctacattgtgcagaagacccaggaaaaactaaaggcgtacagcccggaggatgtggagttcgtcatgtatttcccggaagcccatctgataccggcagtgaaggccctgtgcggggacagtccggttaaaatcggctgccagggggtgtacagggatgatacggctgaaaacggcaatttcggcgcatttaccaccaaccgcacagccaatgcggcaaaggcaatgggatgcagttccgtcatcatcggccactgcgaggagcgcagggataaggccggaatcctggaggaagccggaatcacggatggggatgcagtgggaaggctgctgaaccaggaagtcagggcggcaatccaggccgggcttacagtgctttactgtatcggggaatctgccggggagcaggaacgctggcaggaggtgcttaaggagcagctggagacagggcttaaggacgtggacagggaaaaggtggtcattgcctatgagccggtatgggccatcggaccgggaaggataccgccggatgaagcctatatcacaaaagtcggttcttacattaaggagattaccggcggcatggatgttgtctacggaggcggactcaaggcggacaacgcccgtatgctggcttcggtccctgtcatggacggcggactgattgcccttaccaggttccagggtcagattggattttatccggaggaatatctggaaatcgtggacgcctatctggcacgcaactgattataacaggaggattatcatatgaaattatcatttgaatatggtgcagggctaatggcggcagagcttcctgacagcaccgatgtgttcatacccggcgaaaccgtggcagacccgccctgcattccggaggaccggctggtggaaaagaccctggaatccatacgcaatcccatgggaatggaaccactgtcccgtctggcccgcaagggttccaaggtgaccatcattttcccggacagggtaaaaggcggggaacagcccacttcccacaggaaaatatccatcagactgatacttaaggagctgtatgacgcgggagtggagaaaaaggacattcttttaatctgttccaacgggcttcaccggaagaatacagaaacagaaatccacaacatacttggggatgagctgttccatgagttctggcacacacaccaaatcatcaaccatgacagcgaggattatgagcatctggtggatttgggcaccacggaccggggcgaccctgtgctcatgaataaatatgtgtatgacagcgatgtggccatccttatcggccacacccagggaaatccttacggcggctattccgggggctataagcactgcgccacgggaatcacccattggcgctccattgcctcccaccatgtgcctgaggtgatgcaccgcaaggattttaccccggtcagcggaacgtcactgatgaggacaaagtttgatgagattggccagcacatggagaaatgcatgggaaagaagtttttctgctgcgacgccgtgctggacacaaaatcccgccagatagagattaacagcggctacgcaaaggtcatgcagccccattcctggattatggcggataagaggacctatgtgccgtgggcagaaaagaagtatgatgtgatgatattcggaatgccccagttcttccactacggcgagggcatgggaaccaatcccatcatgctgatgcaggccatctcagcccaggtcatccgtcataagcgcatcatgagcgacaactgcgtgattatatgctcctccctgtgcaacggctatttccacgatgagctgtggccttataccagggaaatgtatgatatgttccagcatgattacatgaacaccctgccggacatgaaccggtacggcgaatactttgccaccaatgaggaatatatcagaaaataccgttactgcaacgcattccaccccttccacggcttttccatgattagctgcggccatattgcggaaatgaacacctcagccatctatctgtgcggcgcccaggaaccgggatttgccagggggatgggccttaagaccagggccaccattgaggaagccctggctgacgccaggaaaaagttcgtgggtcccaaccccaatatactggctcttccccagacctttaagctgggtgccgtccatctgatgatgaaggatgaggtatatgaaggaaaggggcaggaggactgcgggtgtgcctgccatatgcatggataggtgatgcggacagcgcaggataactaaatatagaggcattgctttatgaatcccctcctttttatggagccgcgttaattttgcgcattcttccataaaacgggaggggatttttgcctgattttaacagccggcaggagctgttatagaattaagctataaacccgccccccatcccagttattttaaattgtacactccggccgatttcgattaaaatagaaaagcaataaatgtaaaaaatccaccacattcagaggagaaggattatgtcaacaaacatggaggaaaaacctgtctctgagagcgggcagattaacccactgggccaactgacgagacagcagctaaaagaactggagcaaaaggaaagaacacggggccagaaaatcctggattttattatcatggtgcttccggttatctgcggtttcattgcgattatcgagtactgggaggttcccaacggaagtcccaacagccatccgtatacctatgtatgggcggtgtcggcctttatggctgcgtatgctgtctatgccgttacagcctggattaagaaccggaagggagacaaaagaaccgtggaggacctgcgctaccgcgctcccttgttttccgccttttttctcctgcttacctgttatgattatctgaccttaaagacaggcatcctgtcccagccctttgtcccgtgcatgaacagcatattgaatattgcctgggaggacagggcgtatctgcttgaatgtacgctccacacgctgcgcctgctgtttttgggatattttatcgggattgccctggggctggttacgggtattacctgcggctattccgagagggcgcgttactggattaatcctgtcattaaattcctggggcctattcccaccgcaacatggattcccattatcatggttgtggccgcctccctgttcaggggagctgtgtttattattgcccttggctcctggtttgcggttaccgtggcctccatgtccggcatccagaatgtggacaaggatttctttgaggcagcaaggaccctgggggcaaacgaacggcagcttgttttcagggtggcgattccccatgccatgccgtctattctgcagggctgcacccaggccatgagttcgtcctgtgttgcaatcatgattgccgagatgatgggggtaaaggccggacttggctggtacatgaactgggcgaaatcctgggcagcctacgacaaaatgtttgcagcgctgtttgtcatctgttttatcttcaccattgtgacaaaggtgctggatttgattaaacgccgtgttctcagatggcagaacggagtggtgaaataatggcagagaatacaattatccttcggttggacaacatatcaaagagttttgcaaaggtggagcaggatgaggttacccatgcgttaaatgaagtaaatctgtccatgaaaagcggcgagtttatcagccttgtggggccgtcgggatgcgggaagtccaccatcctccgccttgtggcaggactgattccgcccaccaccggccatctgacggtaaacggagcagagattacagggccgtcgccggagcgcggaatgatgtttcaaaagcccaccctttttccctggctgacagtggaaaaaaatatttccttcagcttaaagctccaggggaaactgaagggaaatgaggagaaggtggagcggatgctaaaggttattggcctggaatccttccggaatgactatcctggccagctttccggggggatggcgcagcgcgtttccctggtgcgctccctgattaatgagccggatatactgctgttagacgagcctctgggagccctggacgcatttacgcgcatgaatatgcaggatgagattctgaaggtgtggcaggagaaaaaacagcttgcaatcatggtaacccatgatgtggatgaggccatttacatgggaaccagggttattgtcatggacgcgcacccgggccgggttgtctctgacattaaaatagatgagccctatcccagagagcgctcttccgggacctttgtggcctgccggaatgagatactcaaccgtctgcacttcggaggaaggagcagcggacgtcagccggagacacagacccctgtacaataaaaagcgcaggccataagcaagagggaaacctgcttttccccacgcctctggctgtgtacataaaaaatgattaaaatcaaaaaggagaacagtatgatgaaaaaaacaaatgggaaacgcgttctggcagcagcgcttgcgggaatgatggctctgtcactggccgcctgcggcgaacagggcggaggaaacccaacagaaagcgcagccacagcagccgccacggcagcggagactgaatcagcagcacaagcccaggattccggcaaagccggggaggaggaagccggcgctgtaagccgtccggaggctgtttccgaggaagactgggcggccatgcagaaggaacctgcctttggcacagccttgaattacctgtttaacggaggcgcctgtgtgtctgccgtgtaccttgccgaggcattgggctactaccaggattacggtattaatgcggaatatatagagggagagtcggttgtcatcacggttggtacaggtaagtgtatgtggggaaccgaccatattgccaccatgcttgtgccggtgacaaacggcgtggagatgacctttgtggccggagcgcatatgggctgcaaatccatctatgtattcaatgacagcgatattaagacagccgaagatttaaagggaaagaccattgctatccatgacggcatcggaaactccgaccagaatattatctaccgtatgcttgacggcgagggtgtagaccccactgctgaggtggagtatctggatattgcagacagtgcggccagcgtggctgccatggagagcggtgagattgatgcttccattttctcagactactttgtaatcgccaattacagcgacaagatgcgcaaggtatgctccattactcccagcgatgagtttgagggagaggtgtgctgcgtaaccgccatgaacaatgacttccttgcaaggaatccggttcacgcaaaatatattgttatggccattaaacgtgccggacaatatgcacgtctccactcagaggacgcggtacagttgatgttcgacacaaataagatgaccggcgagtttgagaatcagcttgagttctgggattccctggacttcggcctgtctgatgcaatcacagaggaagcccttaaaaatatcgcagctgattacatccgccttggggtcatccaaaagaaggagctgacagcagacgatgtcatgaagcttgcatggacaaacgcgtgcccggatgaggaggtagagggcctgaccgtgggcgacccaaaggatgtggcagggcgtaccgtggaggttcagcataagggtgagtaaataagggaccgtataattcaggctgaccgttcaatatatgggcaaacgtttggcaagaaaagcgttgaccttttgcggacttttgcgtataatttttctaacggctgacagaagtcagcattcaggaagaaccagacgaattggatgaagtaacattaataatctaagaagcaaaaataccaggaaggtagtatgtattctcaaggaatacgcttattctggtatttttttatgcgtttgcgcctggatacggattgtgtttaaggaatctgtgctgataggatgtaagcctatggagtgcaggttgatggaaaccaggtatacgggcacggcataaaaaaggaaatggagagggaaatgagacgaggaatgaaatatgctgtggcggccatgctggccgtgtccatggccgtgacgggctgcgccaacagcggtgctaaggacagtacaggccaaaacgcggaaaacagcggtggaaatgacgcccgggagacaggcgataatgggaccagggaggacgtaatcgtggttatggggccaacctcagagccagaggccggatttgaccctgcctatggctggggggcgggcgaacatgtccatgagccgctgattcagagtacgctgaccgtgacaaccgcggacctgaaaataggatatgacctggcaactgatatggaggtcagccaggacgggcttacctggaccgtgaagatacgggatgatgcgtattttacagacggagagaagctgactgccagggatgtggcgtttacgtacaataccctgcgggacaccagttctgtcaacgactttaccatgttggagagtgcggaggcgccggatggcactacggcggtatttcatatgaaccgcccttattccatctggccctataccatggcaattgtgggaattgtaccggaacatgcttatggggctgattacgggtcccatcccattggttccggaagatatattatgaagcagtgggataaagggcagcaggtcatatttgaggccaacccggattattacgggccagcgccgaatatgaaaaaggtgaccatacttttcatggaggaggacgcagcttatgcggctgtcatgtccgggcaggcggacctggcctatacggctgcgtcctattcagaccagacccttccgggatatgagctgctttcctttgagacagtggataaccgtggatttaacctgccggctgtgaaggccgggaccatatctggcggcaataccggggttggaaatgattttacgtcggacgtacaggtgagaagggctgtcaatattgccattaacagggatgagatgattgaacatgtgctgaacggctatggaagtccggcctacagtgtgtgtgataagatgccatggtataatgaatctgcaaagacagaatataaccctgaaaaggcagcagaacttttggaggaagccggatggaaggctggttctgacggaatcagggaaaagaatggcgtcaaggcaggatttacgctgatgtacccggccagcgattccgtacgccaggccctggcggcagacacggccaaccagcttaggaatgtggggatagatgtgaagatagagggagtgggctgggatgacgcctacgaccgcgcccatacagagccgcttatgtggggctggggcgcccatacgcctatggagctgtacaatatttaccataccatgaaggatacagggctggcggagtactcgccttatgccaatgacagtgtggaccgttatatggaccaggccatggccagcgggaatctggaggattcctacgagctgtggaagaaggcccagtgggacgggaccacgggcgtgacacagaacggggatataccgtggatttggctggtgaatatagaccatctgtactggtccagagacggacttaaggtggcggagcagaaaatccatccccacggacacggatggtctattgtgaacaatgtggaccagtggagctgggaataacagaggacaggcacagtatgaatgcaggaaggataaaatcatgagttggaaacgggcgggagttaattttatacggatggcaatcctgctggtgctggtgagcatggctgcttttttcctggtgtctgtctctcctctggacccgcttgccaccaatgtggggcaggcggctcttggcagtatgagcagcgggcagattgccaggctccaggaatactggggcgtcaatacaccgcctgttacccgatatctggcctgggccggcgattttcttaagggagacatgggtatctcccttttgtaccgcaggccggtagcccaggtaatcggggagaagctggccaattctctctggattatggcagcggcatggattctgtccggattcattggattccttatgggaataatagccggggccaaaaagggaaaggctgctgaccggattatctcttcttatgcactggtaactgccagtacgccggccttctggctggccctggtgcttttggtggtgtttgcagtctggctgaagctgcttcccataggactttccgtgcccatcggcgtggaggcgtcggctgtgaccatgaaggaccgcctggtccatggcatactgcctgcggcggccttgtccattacaggtatttccaatatcgcccttcatacaagggagaagatggcagaggtcatggaaagtgattatgtattgtttgccagggccagaggcgaatcggaatggtccattatccgcaggcatggaatccgcaacattctccttcctgccttgacgcttcagtttgcctctgtcagcgagatattcggcggctccgtgctggtggagcaggtattttcctatccgggcctgggacaggcggctgtgacagccggattgggcggggatgtgccgctgctcatgggtattacaatcatcagcgcggccattgtatttttagggaacttcactgccaaccttttgtacggaacagtggaccccagaatcaggaggagcaagggatgagcgcacaaagacacaggtggaaccgccgcaaggccatggcggtgctgctggcggtatcggtcatcctgctggcggccattgccgttgcaggccaggtgctgaaggaacaggctctggccacggattttaccagaaaaaacctgccgcccagcctggcctgcccctttggtacggactggatgggacgcgacatgtttatacgcagccttacaggactttccatcagcatacgcatcgggctgctgacagcctgtatcagcgcggtggtggcatttatcatgggtaccatggccgcttgtctgggcagggttacggatgctgtcatagggggaatcattgacctggtcatgggaataccccatatcctgctgctgattcttatttcctttgccatgggaaagggattctggggcgtactgattggcatttccctgactcactggacctcactggccaggctcctgcggggggaggtcatgcagcttcgtgaaagccagtacatacagattgcaaagaagctgggaaagggcaggttttacattgccttcaaacatatgacgccccatttgctgccccagctctttgtgggcatggttcttttgtttccacatgcaattctgcatgaagccagtattaccttcctgggattcggactggcgccggaacagcctgccgtgggagttattttgtcagagagcatgaaatacctggtcatgggaaaatggtggctggccctgtttccggggcttttgctggtattcgtggtggtactgttccattttatcggggataccctgagccgtctgctggacccggcccaggcccatctgtagaaccttggcagtccgttgcaggaaacattccggaaacatttaagggcagagttttgtttggcaggaggttgacatggaggaaaaacaagtcatattatcagtggagcatcttatgatttcatttacccagtatgtaggggggtggcgccagagggagcttcctgtgattcgtgacctgaacataaaggtacgggagaatgaggtggtggctgtggctggttccagcggttcgggaaagagccttctggcccatgcggtcatggggcttctcccgcagaatgccgcctgccagggaacggtttcctttgagggggaaattctgacccagaagcggaaggaacagcttagggggagccggatggtgctggtgccccagagtgtgtcgtatctggacccgctcatgaaggtgggtgaacaggtccggaggggacgaaaggataaggagagcgtggagcgctgcagcgaagcccttgggcgctacgggctgggagaggatacagagggactgtatccttttgagctgtccgggggaatgaccaggcgtgtgctgatttccacggcagtgatggagcaccccagactggtcattgcagatgagccaacgcccggacttcatatcagtgctgccaggcgcgtgctgtcccatttccgggaaatagcggatgagggcgcaggcgttctgctcattacccatgatttggagctggccctggaagtggctgacaggattgtggtattttatgcaggcaccaatgtggaggaggccctggcagcggattttggggatgagcagagactcaggcatccctacaccagggctttgtaccgggctatgcccagccacgggtttaaagcagcttccgggacccagccctatgcgggggatatgcccatgggatgtccctacgggccccggtgttcggatagggatgagggctgcctgcaggaaatttcctatcgcagttttcgtgacggcatggtaaaatgcaggaaggcgggagtatgaagctggaagcaatcaatatttcattccaatacgacaatgggaacaggagaatcctgaacaatgtcagcctgagtctggaaagcggggaacgtgtggggctgacggctcccagcggctttggcaagactactttttgcaaaatactggctggttatgaaaaaccggaccatgggactgtgactctggacggaaaaccccctgtctcttacggaagctacaatccggtgcagatgatatggcagcatccggaactgtcggtaaatccccgtcttaagatgggggaggtgctgagggagggggactcggtggaggagcgggtggtccgcggactgggaattgaaccggactggctgaaccggtatccgggagaattgtccggcggggagttgcagcggttctgcatagccagggccttgggaaagaggacccggttcattctggcagatgagataagcaccatgctggacctgattacccagagccagatttggggttttcttctggaggaagtgaagaggcgggatttggggctgctgatggtcagccattcggaggaactaacggaacgggtctgcagcagggtgattgatttgagagaggagaacgaaagatggacgtaagggaattgctggaacaggtaaaggccggcagtattaagatagacgatgcagagaagcagcttaaggacctgccctatgaggatttggggtatgctaagctggaccaccacagaaagctgcgttccggttttggggaaaccgtgttctgccagggaaagccggatgcataccttttggagattttcaggaaattttatgaaagggacggagaggtcctgggaaccagggcatctgcggagcaggcggagctggtcagagcggcagtgccagaggcagtgtatgaccccatatcccggattctgaaggtggagaagccgggaaaggaacgaaggggctatgtggcggtgtgtaccggaggtacggcggacataccggttgccgaggaagcggcccagaccgccgaatacttcggctgcagggtagagaggatatttgatgtgggagttgccggaatccacaggctcctggcccaaagggagcgctttgataaggccaactgtatcgtggcagcggcggggatggagggggcgctgggcacggtgattgccggcctggtggagtgccctgtggtggcagttccaacctctgtgggatatggagccagtttccacggattatccgcattgcttacaatgcttaattcctgtgccaacgggatttcagtggttaatattgacaatggatacggggccggctatctggcgacccaaataaacagaatggcggtgagataagatgggaaagattttatatttggagtgtaattccggtatcagcggggatatgacagtgggggccctgcttgatttgggggcggacaggcaggttctggagcatgcgctggaaagcctgggcgtgaatggatatcatcttcactttggccggaaggttgtgtgcggtctggatgcctttgattttgatgtgcatttggaggaggatgggcatgagcatgttcacggcggggagcatgagcacagccatgagcatgttcacgatggggggcatgagcacagccatgagcatgttcacgatggggagcatgagcacagccatcaccatccgcacatacaccggaaccttcacgatatttaccatatcatagaccatctggattccaatgagagggtgaaggagatggccaggaatatgttccgcattgtggcggaggcggaatccaaggctcatgggcttcccattgagcaggttcatttccacgaagtgggcgccattgattccattgtggatatcatcagcgtggcagtctgcattgacaatctgggcgtggaggatgtggtggtttctgcattgtcggaaggtcatggccatgtccattgccagcacggcgtgctgccggttcctgttccggctacagccaatattgcatcatcctatggactggagctgcattttacagacaatgacggggagatggtcacccctaccggggcagcggttgccgcagcactgcggacaaaggaccggcttcctgcttcctgccgtctgcttaagataggaatgggcgccgggaacaaggtgtttaaacaggcaaatgtacttcgggccatgctgcttgagacttcacaggatgagaaccgtaccatgtgggtactggagacaaacctggatgactgtacaggggagatactgggacttgccatggagatgcttcttgatgcaggggctgcggatgtgtggtatacccccatctatatgaagaaaaaccgtcctgcctatatgctgtccgtgctctgcggggaatcgtccgtagaggccatggaagaaatcattctgacccagaccactaccattggaatacgccggtatcaggtggaaagaaccatccttgggcggaatgaaatccaggtggaaaccggttacgggccggcggatgtgaaggtgtgtacttataaaggcagaacattcttttatccggagtatgaaagcatccggcggatttgcagggaacagggcgtggattttcaaaccgcataccatgaagtccgtatgaaggcagaggaaagccggcaggaaaaatgataaggatgatatcagattaggagattcgtatgaatatggaaaacaacactgacagcgatgcagccttattcccgcaccatttgagaaagcagctggaggccagaatggaacagctggccagggaggatatctgcctggcattttccggcggcgtggattccagcctgcttttaaaggcagctgcagacgcagcagcccatacaggaagcagggtgtatgccgtgacctttgacagccggctgcatccttcctgcgacctggagattgccagacgtgtggccggagagctgggaggaatccatgaagtcataaccgtggatgagctggagcaggaagcaattaaaaataatccggtgaaccgctgttacctgtgcaagcgccatcttttcctgaaactgacagagctggcagaggcaaggggtatccgccatatcctggacggcaccaatgaggacgatatgcatgtataccgtcccggaatccgggcattgaaggaactggggattttaagcccgctggcagagctgcacataaccaaggcccaggtaaaggccatggcatcggagtacggcatatcggtggcgtcccggccgtccactccctgcatggccacccgcctgccctacggcgctttgctggattatgaggtgctggaacgaatcggagagggggagtcctatgtcaggaccattattcccggcaatgtacggctcaggcttcacggagatattgtgcgcctggaactggacacagaggcctttggagtattcatggaacggcgggaggaaatcgtcagccgtctgaaggagatgggctttgtatatattaccctggatgcagaagggttccgctccgggagcatggacacgggggtgaatgagggacggatgaaggactgatggagggctgtgtgaggccgggaaaagtgaggccgggaaaaaaaccaggaaatgtgtgcctgggaagaacccgcaggaaatccgggcatttaaaatccggccagaactaaaacattatcagtaattgggatatattttgcctgaaaaactccaaaaggattataaacattttcattctttctgtttcgcctgtattatctatatatagataatacaggcgttttccactttatcccatattgtttctattatccaaaaacgaatattttcctctgtttcttaacgaaattgaactttactaccataaaaaaccgtgttagaattaaaatcgtgagtttgtaaattttacgtaaagataaagtaaataattaagagagtaggtaaaaaagaattatggacatgtcgttttcctttttcctgcggcagctggtgacaaatccggccctgttgatcacagtccttctgacccttggggttatctgtgtcaatggcatcacggacgcgccaaatgccattgccacctgcgtgtcaaccaggtcactggatgtgaacctggccattgtcatggcggcagtctgcaactgcgcaggagtggttgtgatgaccatggtaaattccacagtcgccatgaccattaccaatatggtcaacttcggagatgatacctccattgcactggtggcactgtgcgccgcactgttttccattgtggtgtggtcgtcctttgccgtatccattggctgtcctaccagtgagagccatgcgctgatagcaggacttacaggtgctgccgtggccatccggggcggattttcagccatcaataccgcagagtggatgaaggtagtttacggcctggttttttctgttgtactgggatttttaagcggttacctttcctgtaagctggtggcctggacctgccgggacatggaccgcaggaagaccaccggatttttccggtacgcccagattggcggggccgctgccatggcatttatgcacggcgcccaggacggacagaaatttatgggcgttatgctgttaggcatctgtatggtcaacgggtccagcaatacccagggagtacagttcccgctgtggatgctgctgcttgggtcggcggccatggcgctgggaacatctatcggaggaaagaaaatcatcaaatccgtgggcatggacatggtacgcctggaaaaataccagggcttttccgcggatatggcgggagctgcctgtcttctcggtttttccattttcggcattcctgtcagtaccacacatactaaaaccacggccatcatgggcgtgggagctgtgaaacgcctgtcggccattaacttcagtgtggtcaaggatatggtgatgacctgggtcatgacctttcccggctgcggtattattggatttctgatagcgaagctgtttatgatgttgttccatggataagtaaaggagaagataagatgtctaagaaaagtgatagttactattttcagaatttcatcgagtgtgtggagtgcggatgtcaggcagctaaaatgctggaggacaatctgaaccattttgatacaggacttttgcaggacaagctggacgagctgcatcggattgagcatgatgcggataagaaaaagcatgagatgatggctgtgctggtcaaggcattcatcactcccattgagcgggaggatatcatccttttgagccagagtattgatgaggtgacggataagattgaggatgtgctgattcgtatctacatcaacaatgtccagaaaatccgcccggaggcccttgcctttatcaaggtcatcatccgttgctgccaggcccttaaggaggttatggaggagtttgcggacttcagaaaatccaaaacccttcacggcctgattattgagattaatgccctggaagaagagggcgaccggttattcattgactccatgcgcaggcttcacgccgaggtgacagaccctattgaaatcattgcctggagggagatttacgcctacctggagaaatgctgcgatgcctgtgagcatgtggccgatgtggtggaaagcgttattatgaagaatacctgatgtccggcagagcctgaacagcctgcaggcggatatggaagaatacataaaaaagagagaaggcatcgttcccgggtgatgggaaacgatgccttatttattggacggttttcagattaatagatgctgcctcctatatgtaccagctgttccagaagggcctgcatcctgggaaccgccggatggttttccaggccatattccccaaagaccgagtccaggcgggggaaggccagccatgtgctgccggcttcatcctcccaaacggaaatgcgcaggggcagttccagggatacgctctggtctgctgccatgagtccggtgcctacctggggagaaccgaatacaagtacggtggtcgggcggagagaaagtccggcatcagcagcattctgtccatggtcaaatttggcgaataccgggatgttccgttccttaagggctgtttccaggcgggatactgtttccgccgcagagaactggccttccaggaggaagagacggttgtcgtcgtatccggtggacagaaggtcgccgtaggcgcctgctatccggcggcccagattggtgaaatccacaccttccttattgcacataagggtgacgcagaccagctcggcggcatcggtaaagcggctcaggaaggatgagtagccattgacagatccttttatatccatgagtccccggtgatggtaaaactgccatccggctgcggccggaactgtttttccatcaggaagattccatggtgcgtagatgagggcgcggttttccggcttatgaatcaggacagagcctgccaggccgatgtcccagaaggagatatcctgggcagaggcccatatgtcggaaaagccccgcagcgccgtggattccgctgccggtatgggagagccgctgctgtcataggatacggcaggttccgtgggattgatatagagcctgtcctttttaaataattgatggatgttgtctgtctgggaaatgtcctcataatggaaacagcccaaatcctctttaaaacccgtgtgtgcaaggcccaggaactcaatctgacggctggtcacgaaatcatggtagctctgaccgctgacccgttccacgatttccgtcagcagcaggaagttggtcgcactctgttccacatctgtgcccgggataaaatgcagggattctccggcagccagccgggtcagggcctcaaaggtccatggggtgtctggtctgaaccctggagcgcggcggtagtccggcagtcccgatgcatggcgaaggagatgaagaagggtgacattcctccaggtctccggcagctccagtatgtaggcagaagcttcactgtttacatccagtccgccgtcctcatgaagctgcatgattgccacggctgcaaatgcctgggatatagggccggccggccacatggtgttgggggaagccagacgcctcctccggctgtctgaatagccatacccggctacccttggtatgtagggggcctgtacaatggctaaggtaagcccgtcaattttttccttctccataaagctccatatcatctggtcaacggtatgacccagataggagatatcagggttacctctcattttcatggatgtgtgttcgcgggttttcataatttggctcctttcctgattctgctgacaatccggcgttaactgtaatcgcaaaaaatacatttcatactgtaactataatacttacagattgatttgtcaaggtattatccggaagtatttaatctttacagtttaattacggtttgaacacacagttgcataaaaatagagaatgaattataatgtaacaagtgcaggatgaatcatatctgtctgtgataaggcagctaagggagaatgaaaggagattcagtatgaagaaacgtttggcagttacattagcggcattggccctgagtgtggttatgtcagttccggcttatgcaggtacatggaaatatgtgaacgaccagtggaaatatcagagaggcgccaataagtttgcctacaaggagtggattcaggataacggtaactggtactatatggacaataacggcgtcatgaccacgggctggcagcagattgagggacagtggtattacatggaccaggccggagttatgcagaagggatggtttaaggataatgataaatggtatttcctccttcccaacggagccatgtccacgaacacagtgattgacggacgccagattggcccggacggtgtatggattgcagcggagggagaggcggaaccagccaacataacagacctgtccacgccatatctggtccagaacctgttggacggactttccaccaagggatacaatattattacctcgggcaagacatccacaggggagcgctggaacaatgccatccgtctgaagggaaaaggaagttacgtgaagtatgctgccaatggacagtaccggctcttatccggtgtcatagccccttcttcccagttcagcagcggaatcatggctaaggtgactgtatatggtgacaatgataccgtactttatacatcacaggatatccattacaatgaaaagctgatgtatttcggcgtggatgtgaccggacagaatgaggtccgcgtggaggtttccctggttacggacaatgagtgggatgaacccatcatactgatggatggactgtcgctgtataagtaggcaggataaagatgtccgggaaacggaaaacggacgaagcaaatataaatgaatcataagataacaggctgagggccccgcctttttttgcgcagggtgactcagcctgtttattggttcagggaacataccgggatgttggcagggggcggcagcaaaggcagcatttgctgattccttcctgagattctggtccggaagaaatttccggttatcatcattacaatataggacagacttgccatcacaggtaaaaagcatgccgatatagcagattgagctgcgattggactgattttggtcccattatatctttaaaaatgaataagattaaggataaaaaggactggaaccagtccagatatatggggtggcaggatggacgtaattaagaatgacggaactaccaatataggggctaatatccgcagaatccggaaggaaaaagggattgggcagacagagctgattcagaagattgacctggtggagtgggattttgatgtgaatctcaccagggaggccctggtgaaaatagagcggggcatccagcatatcaaggtgtcgcagctaaaggccatcagggccattctggaaacaacctatgaggagctgttaaagtaggaggttatatggagttaggacatactattccgctgcagaaatacctgaggatgcagccgcctccgtatggcgcgggctgtcctctctttttctgctgggagcttcacagaatcatcctgcagtccggggatacgctggtggctgtcaatgccggaaaccgctttgcagtggtattgtgggggatggacgccggtgcctggaaccactaccaggagcatttccgggaagggctggaaatggccatggagtcagagggatataccagggaggaaatccgtatatatttgaagcgggcagggaagttccaggtcacaaagacccatggaaggcgttctgtggccgggcttaaccagatggacaactgtctgtggaaaatcccggccctggtgaaaaaagggcagctgttccagcctgtgcactgccatgaggtaaatcgggaacgctgccggatggcagggtacgagggctgtcagtatcctgtgcagtgctttggcatggatatggaacaaatgctttcagaacagcaggatgcacaggaaccatgtcatgatacaatcctgcagcagtcataggtcagagccaaaatagcatcaccgccgtccgaatccatgaatatatgtacggccatcatgaacgccatatacattcccttgcagttttccgtaatatccaggccgctgctgttgcgaaagaggacatcgatggtcccgctgtcccgttcaacctgcagcagggaagaggtcatctgggcgtattccttgaagatgggaagaagtgtgtggtcgaaccatatattgtgccgctcatattgggccagcagggcagtctcgcggatgtttctgactgcctccctggccatctccagttccttttctgacatgcaatccagcaatccatagatatctttggcattgccggcgtctgtgaagtcgtattgttccataatctcacctcattgaattctttgaatgctggactggttctggtcccattatatcataaaacctgcgcaatatgaaggaggaaatggactgaattgggttcatataacggggcacaagagaagggccgtacacggtatgcgcagtgtacggccctttaagggtacatgtataacgggattgtctattcaaacacaacgattgcttccggatttttaatccgcagcgcagctgtctccatcaggcggaagacatgattaaaatctttcatttccgagtaaccgatagagaagtccatgcccagggccaggtccatgtattccggttccgcacacaccaggaccgccttgcctgtgccaaaatcgccaagtgggaggatgtggccgtcaatcagctttttgatgcggtctgattccagcattccggcagactgctgcaggcgctgcagcgccagatataaatccgggctcacaaccagggccttgcgtccctggcagccggctgagaataggtgtgaaatgccttctgccacattaataaatgcattctctccctggttccagtccttcatcttaatatgataggaaccggaggcattcatcagaccctgtaggctgagggaatcattgccatagagaatcagctcatcctcgcgtttggcagcccgctttgcagcagcccgcacagagcttaaatcaagaggatagccattcttttcagcttcctcaatatccctccatgagagaaggaaatcctcataaaacaggggaagctccacctggcgtctgccggacatacggccgatgccattgtctagtatctcttccttatcaggaccgtccaccggtaccatggaagcgccggcgcccaggggcccgaacagatttaaaaagcggcggcacaccagatgtttttttagtgctccgattgctgcgtcatcaatttgtgcccagaattctgatgaaaatggtgcactctctcttgctaaatagtccataggttccctccttattatgattcgtccagcagactgcctaccgacagcggcctggaggcagtctcctcaccggcagcgtcagaaggagcagcggctgctatgccaagttcctccagcatttcctttacctctgactccccggagaggaagaaatccgtctccctggggtccaggtagcgcatcaatgtaattaattctcccatatgtgccttctcttcgtcacgaatgtcagccagaacagccttggctgccgggtcgtccgtggccaggtagtgggattcatagagatagatggcttccagctcaccggctatatccagccggatggcctgcatcagctctgcattgctcagtttccgttcaacatttccctgaaaggggtttgcaaaatttggcatgtgtttcctcctttggtctgctttattgtgtttgattataataatgataataattactatttctgtttttataatagcatacgccaggatgaattgcaaggattatttttcaaagattttgcagaaatataagattatggcagatgaatggcaaaggcagctgagataaagggtataggaattatatgattgaggcaaagggtatggggaccaaatgacgtccacatgacatcaacagggaattaacaggatatccacaaagttatccacattatccaccgaaaacactagatatttcatgtgaatcgtctgaaaataccagatttggtactgtgtataactgaattgaggggatgaaggattgtggataagtattggaggggaactttgtttatggcggagggattatgccggggggatgtaagaaaaagaatggaataaaatagaagaacgtggtataatcaatcaggtgcctgttaaaggcggatgtggaagaacatgatatttggtatgtatgaaatgcaaataaaaaatgccagaagcctttaaaaggattctggcataaaaaatcggagtaacaggatttgaacctgcgacctctcggcccccagccgagcgcgctaccaagctacgccatactccgttcttgaaccttgattattatatcagatattttccattttgaaaagacctaattttaatttattcggagaatttaaaaatgacacagataccaggtaagaaaaagcggattgtcagttttgatttggatatgacgctgctggaccataagacatggaagattccggaaagcgctatgaaggccctggagctgctgcggaaggattcagtcatcgttataggaagcggcaggaacatggaccatgagatgagcgctgtgtacagggatatggttatgccggatgcagtgattcacatgaacggcacgcgggtggtggcagagggaaatgtcctgtttgagcatctgatggacaaggacaggctcagggcgctgctggaatacggcgaggcccatgggatttccctgggggtcagccaggagggcgatgattattatatccaccccgagggcgtagtgcgcatggaccagcttcgctggggcgtttcggagcgcaattttaaggatggctggaagctgatggatatgccggtcaggaccctggtgtacataggcggtccggagggagccagggagctggaagcccattttcctgaattcaagtttcccatgttctcggggaacatgggagcggatgtggtggaacaggaggcgtccaaggcagaggggctgaagcggctgtgccagtattatggcattggcctgggacagaccattgcctttggagacagcatgaatgactatgagatagtccgggaggccggcatcggcatagccatgggcaattccgtggaggagctgaaggctgtggcggattatgtcacagatgatattgaccgtgacggggtatggaaggcctgcaggcagctgggcctgattcagatttgacagtttaaagaaattataaagagataatttataagaacataagggagaacgggtatggcaagagaatttgatgtagtgattataggagccgggccagggggctatacggcagcgcttaaagcagcggagtttggcctcaaggtggtggtgatagaggcaaaaaagattggcggcacatgtgtgaacaggggatgcattcccaccaaggcattgctgcatgcatccgatatgtttcatatgatgcagagctgtgatgaatttggcgtgtccacggatttcatttcctttgattttggaaaaatgcagaagtataagaaaaaagcagtggtcaaataccgggagggcatccaatacggctttgagaagctggatgtggaaattgtatacggaacagcggtccttcgcagggacaggaccgtggaggtggagcttaaggagggcggccgggaattctaccggggaaaagcagtcatcatagccactggtgccgtaccctacatgagccggattcccggctccaacctttccggcgtgtggaacagcgacaggctgctggcagcggagagctggaactttgacaggctgacaatcatgggcggaggcgttattgcggtggaatttgccaccatgttcaataacctgtgttcccatgtgaccattgtggaaaaacagaagcatctgatggcacctatggatgatgtgatgtccgctgagctggaaaaggagctgcgccaaaaaggaattgatgtatactgtgacgccacagtcactgagatattggaggaagagggcggactcagctgcgtcattactcccaacggggagggcgagcccgttaaaatgcgggcagggcagatactgatggccattggacgccgtcctaatgtggagaagcttttgggcaaggatatttcccttgaaatggaaggcgggaagatagctgtaaacagcgacttccagaccagcgagccgggaatttacgccattggggatgtgtccgccaggacccagctggcccatgtggcagcggcacagggaacctatgtagtggagaagattgccggaaggccccacagcatcaagctggaggtagtgccgaacggtatgtatgtgtcccttccaatcgtgccaaactgtatctatacagaccctgagattgccacggttggcattacggaggaaatcgccagggaaaaggggctgaaggtgcgctgcggtcatttttccatgagggaaaatggaaagtccatcataacaggcggggaaaatggatttatccgtctggtttttgaggcgtactccaatacaatcgtgggagcccagatgatgtgtcccagggcaactgacatgattggggaaatcgctactgccattgccaatgggctgagcgcagaggaaatgtcctttgccatgcgggcccagcctacttacaatgagggaatcggagctgctatcgaggatgccatgaggaagagatagcgggagcaggagatggaaggatatgcagacagctatggctgacagatagtaagaaatggaaggatggataatagtatgaatgtaattcagggcaggttggatgcgctgcgggaattgatgaaagagcggggaatggatgcgtatatgatacccacagctgatttccacgaatctgaatatgtgggagagcatttcaaatgcaggaaatatatgactggattcaccggctcggccggtacggccctggtgaccatggacgaagcctgcctttgggtggacggccggtactatgtgcaggcagcggcccaattaaaggataccacggtgaccatgatgaggatgggacaggagggcgtaccgtctctgggagaatacctggatgaaaagatgcctgagggaggctgtctgggatttgacggccgggtcgtcaatgcggccgaaggacttgatttggaggaactgctggaggaacggggcgcacacatttcttatggggaagacctgacaggcatgatatggaaagaccggcctgagctgtcagcagaacctgcatgggtcctggatgagcggtatgcaggaaagagcgcatccgataagatagcggatgtgagggaggccatgaaaaaggcccatgcatctgtccatgtgcttacctctctggatgatattgcatggctgttaaatatcagaggcaatgacatcctgtacaatccggtggtattatcatatgccctggtgaccatggaccagttgtatctctttgtcaacagcagtgtgctggaaggaaaagcttatccgtatctggaggatgcagaggacataagcgtgaaggaatacctggaacgagcaggcgtcaccgtgatgccttatgatggtatataccgcatggcggaggaacttaggggagagagggtactgctggagaaatgccgtgtcaactatgctgtgtaccgcctgattgacggttccaataaagtgattgacagaatgaacccgacggcagccatgaaagcggttaagaataaggttgaaatagaaaatgaaaagcgggcccatatcaaggacggcgtggccatgaccaagtttatctattggctgaaaacaaatatgggccggattccaatggatgaaatcagtgtgtcggactatcttgagaaactgcgcaaggaccaggagggatgcattggactgagctttgcaaccatatccgcatacggagcacatgcagctatgtgccactactcagccacgcctgagagcaatctgcctctggagcccaggggactgtatctcattgattccgggggccagtattacgagggaacaacggacattaccaggaccattgccctgggaccggtgacagatgaggaaagggagcattttaccttggtgcttatgagcatgctgcgtctgggggatgtaaagtttcttcacggctgccgcggactcagtattgactatgcagccagggagccattgtggaggagagggcttaactatgaacatggcaccggccatggagtcagctacttgtccagtgtgcatgagcgccccaacggcatccgcttcaagatggttccggagcgccaggacaatgcggtgatggaagccggcatgattacatcggatgaaccgggagtgtatattgaaggaagccatggaatcaggacggagaatctggttctgtgtgttgaggatgagaagaatgaatacggacagttcctgcggtttgaatatctgacatatgttcccattgatttagaggtaattgaccgggagattatgtctgaccgggatgtggaactgctgaaccggtatcataagcaggtgtatgagaagattagtccgtatctggacgaggatgagagagcgtggctgtctgaggctacggaggcggtttgaggctacgaaggcggtttgagatatggggaaggggaataggtgttttttgggggtgtgcagggtgtagttatggtttgggcaggtttggggatgagggtgaagctggcagcaggggtgtacggattgagaaatagtggaagggatggggctggagctggttttcagtcttgccccggtgcagatagcgggtgttgggggttgggttaaacgttggtgacgcgacgtgggattagcaggttaaaggtggctgggcagtccggcggcattgcagaatgcagagcagtgctgcaggaggtgtccggccttttttgggggatggtgagatgcgtgctttggtcaattgatatggttatacatcagggaaaatatatggtagaatggccatagggattttaagtgagaggatgtttgagaacatttgacggggagattgggagccatagaagtgggatgtttggaaacctggagatgttaaaagctgaaaatgggatttgacaggcgggtagagtggcagtgggaagaagtcaggggaataggaaggaaattcggatggcaggtgaactgtgtctaaacatgaatagcaatcagaacgaattcaaacagggaagtgtcagatggagttggactggggattgttgcaggtataggaatttaatgtgaatattaggagacggaaaaatggatagagcgatggatggaagagtgaataaaaagaaagataaaaatgcaggtacaggaatcaggaacggaggaaacgggactaaagttaaaggaatggacagcagacataaggtgaggaccggtgagagtaagactggtattggcaaaagcgggaagataacaggtaaaatacaggatggggagagggataggaatagaaacagaggaaaagagggggagcggagtggagaacggtttggagataatgcttgggaacggaagagagatgggggtggagtgcggaaggataatggggcaggagtgcggaaggataatggagcaggggtacggaaggacaatagggctggagtgcagaaggataatagtgtaggagtgcggaaggataatggggcaggagtgcggaaggacaatagcgcaggagcatggaaggacaatagcgcaggagcgcggaaggataatagagcaggcgtacggaaggtgaatagaacaggagctcagaaggacaatagggctggtgagcggattaaaggtcagtttgtgaaggatgaggatgtttttgcaaagcggaatagccgggagaaaggcaaggaaggcggtttattaagtgaacataaaagcggtgatggcttgctgttacaaataaagcggaacggcagggcatttgctggggaagctgggagaggggattataaaaagggcggctcatatgcagggcgtagtgctaaaaagggtaagagtatctgccctgtgatgaatcagtgcgggggctgccaattgttggatatggagtatgcagaacagcttaagtttaagcagaaacaagtggaagagctgctaaaagggctctgtcctgtaaagcctatcataggtatgaaaaatcctttccattatcgtaataaagtgcatgctgtatttgacagggacaaaagaggtaatatcatatctggcatatatgaagaaaatacccatcatgtagttcccgtggaaaaatgtcttttagaggaccagaaggcggacgagattatcggtaccatacgcggaatgcttaaatcatttaaaattaggacgtatgatgaagatactggttttggacttctgaggcatgtcctaatccgccggggattttccacaggggaaatcatggtggttttggtcactgcttctcctgtgtttccgtctaagaataacttcgttaaagctttgcgggagaaacatccggagattaccaccattgtccagaatatcaatggaagagggaccagtatggttctgggagataaggagcatgtactgtatggaaagggttatattgtggatgagctgtgcggatgcaggttccgtatatcgtcaaagtcgttctatcaggtgaactcggtgcagactgaggttctctatgaaaaggcgctgtctctggccggcctgaccggacaggaactggtggtggatgcatactgcggtattgggaccattggcatcattgcaagcaagacagcagggaaagttattggagtggagctgaatcaggatgcagttagggatgcggttagtaatgcaaagatgaacggaatcgaaaatattcgtttttattgcaatgatgccggccgtttcctggtaaatatggctgaacagggtgaaaaggccgatgtagttattatggaccctcccagaagcggaagtacggaggaattcatggatgcagtcggaaggcttggagctgggaaggttgtgtatgtgtcgtgtaatccggaaacactggccagggatgtgaggtatatgaagaagctggggtatcgggcggtggaggcttggccggtggatatgtttggtgggacggtgcatgtcgagacggtatgtttattgtccaaacttaatgcaaagcaacatatcgaggtagacatccacatggacgaacttgatctcaccgatgcagagaagaaagccacctattcggaaatcaaggaatatgtgctggagcataccggactcaaggtcagcagcttgtatatcgctcaggtgaagcagaaatgcggtatcatcgagcgagaaaattacaacaaaccgaagtccgatgatgcaaaacagccccaatgcccgcccgataaggaaaaagcaatcaaggaggcgctcaagcacttcggcatgatctaaggagggcaaaatgaagcgtttactttcttgtgagttcaatatggatactgcctgtgtggagctgaaatttgcaaatggcagcatgattgccattgatacgattgcggtagagaatgaggttgccgataatatatatcagcggtcagagctggactggctgatttacaacgatccggcagcctatgcagatttagttctcaacggcgacccggaaacatacctgaaaactgttacagaatataaacctttggactgattaccagagataaagcaagccgcctgtgcgggcatatcaaatgctcatacaggcggcttttcctttttgtactgtgactttatcagttctccgaaatggaccgcttaaacaatatccatgtacttatgaagtagcatatcagcagtaagaaaagaataccaatgataatccctacttgtaccatcaaggctccgcagccaatataagctgagatttcagcagaaacactttgaagaaaatagccaatcacaataattgctacaacgattgccgctgtgatcggcatcccaaaccaaacaccaagctgttttagaaccaaagtatgcaggtccttctcttccactcccatttttcgcagaaccgaaaatctgtagttgtttttttctgcatccaggagctgctgaagagccagcacggtaagacacatcaccatcagaacaattgcaccatagatcaaggacgcttttaggataaagttaagggcgattatacggttcacttccgtagtatggacagttgtactgtatcctgccagattgtctttatcaggatcttctggataagaacgcccaagaagctgttccagcatttctgccgttttgaagggaagcggatattgggtcatcacaaatcggttgcgctgtaccggaagcaagacttgcgctatttcgtcaggtatgatatacaccacatctgtataaagattatagatggattcccccacaggctcctgaaacacggcgttctcactaagtttcagggtgcctgcgtcagtttccaataaggtatgctcagcaatgtagttttcaatatccttgtcctctgctgcacgatgccagtgggtagcaaattcatccgtttgtaagataataggttcatatcccaacattttccgaacagcgttataatccttcagtgcgatcgccaagggaggaaaattgtactttactcgctggtgaaagtcgctttgcttgggaagatattccgaaaaagtcaaatcgtcctttatcgctattttgttttgttctatgaacgcagtaatttctccatagtctgtatccggaagattttccacttcataaacatcgttgtagcggcttgaaatttgaatatcatagacagcccgactgtccaaatagcccagactccatcccgttaaaaccggcgcaatgacaaacaagcagatagaaaaagtcagggtcacacaaatgatcgtcatcgttttcgtattggtagccagcttagaggaaagctgtccaaacagaaataaactcgtattatgatatttgcgggacactttagactccttccagtataggagcgccgcattcgataaatacatgactgcggaaatgataaacaaaatatccgcaaccccaaacagcaaatattgattcagagttggagcgtcaaatccaaggaagtaggctttttccagttctgcgatggaaaaaatcgggatagcggtcaatacagcaccagccagaagtccgcaaagatatcgggaaaaccctatttttctgtgtaaaacagcacctgcgattgcccaaagcagcgtcagtgcagggaaaaggacattcccccaatacatgagctttacaggaagcggatgtctggaatcgaagtaaaaatgatattttacagtacctacctccagcatccacagcagcagaatgccatagaaaatacagatcatcggcatccatctgcttttatgaagcggtttttcattctgacggtttgccgtcataagctcaataatcctgcttttgttgagaattctgacattcccgactccaaccagaatctggcaaacaacaaagaagcccacggtcaacagcacagtatccgggaaaaacgaccaagaaaaagcgtagggttccccaaaagaagcaagcagcatagccgtaatgacctgagaaacgaccatccccagaaggattcccaccgacacagagaatatgagcaggaaaaaagtctctccaaaaaagagcaggcctatggttttttgctccattcccaaggttgcctcaacggcaaactccttttgcttttttctcagcatgaaacgattgacatagtggatcagaaacaacaaaagcaaactaatcccgcaaattgccagtttcatacctccagccagcagggaaatattatattccgcaccaatggtcggatgataatgggtgctgctgatagacaaaaacgcatagaacagggtgacacagagtgtcatggtcacaatataaatcaaatagtccttcacagaccgctttgcatttttgaaaataagtttagcgtacatcgctcgtgccccctcccatcatggtaaggacatccaggattttttcaaagaaagtcctgcgggaatcaccccccttacggatttccgtaaagattgccccgtccctcataaagagaatacgattggcatagcttgccgagaaagcatcgtgtgtcaccatcagaattgtggctccgagatcttcattgatactctggatcgtcgagagcagcatctgggacgagtgactgtctaacgcaccggtgggttcatccgccaaaatcagcttaggctgattgataatggctctggcacaggcgcaccgctgcttctggccgccggacacctgataggggtatttgtccagaatatccgtgatattcagctttccggccatttcccgcacccgcccatcaatctcgcctgctggaaccttgttgatggtcagcgccagggctatgttttccgaaatggtcagcgtgtccagcaggttaaaatcctgaaatacaaatccaagattctcccgacgaaaccgggcaatctgtttttcgttgatttccgtcacatcggttccgtccagatagatatgtcctgcactgacggtatcaatggtggaaatacagttgagcagggtagtcttgccggagccagatgctcccatgattcctacaaattctccctcttgaacggaaaagctgatgtcctgaattgcttttgtaacatttccgccatttccgtaatatttttggatatgatccagtttcaaaatttctttcattgttatcacctctgatctctattgtaaaataagagtggcttcgtttgtatcaagttttcttacaaagttctaacaaaaatgtaagaagtgcagaacgcttttcagttctgcacttcatgaatcagacagttaatgtgaaaagaaagggaaatggctgtgccatgttccgacgactccgccgtaatgccaatgcccagcttttcacagagccgtttgcacagatacagaccaatgcccgtggactgctgaatcagacgaccattctgaccggtaaatcccttttcaaagatacggggcagatcggacgcagcaatcccgattccattgtcctccacgacaaggacaacctgatcctgccgtttatgagtagaaatgcggagaaccggctgcttcgtacgatacttgaccgcattgacaatcagttgatttaggataaaacgcacccacttttcatctgaataaaccgtatcctgcatttcctccacttccaggcgcataccactttggagcagcagatatttgttatctgcaatcgcctgatgcaccacttgggacagtgccatttcccggacagaataatctttctctgtatgctcactgcgggcataataaagagcctgttccgtaaagcggttggtcttttccagttccagcagaagttcttttgtccagttcgtccgatggttttcacataggagtttcatggcagtaatgggcgttttgatttcgtgaatccattgttcaatgtattccttgtactccaggcgttcccgctcgacctccccaatctgctccaacatggattttccagccattttcaaaatctgatagtaaacctgatcctcggcctgttccggcagttccatcacttcagaaataaggtatctctcggagagctgcttcgccatatccagaagttttttcatctgccgctttcgtttccagtaagtgaggacaagtcccatcagcaaaatcaatgcccatacgatcaggatcaatactactgcggaagccgaattgccgcacaccagcaaaaatacagtgagcgcagccatgcaaacaaggttcgtcagcagaaatggaagcctgtttttccaataccgtttgctgttcatatcgtgtacccctggcgatgctttgtcttgataaaatccgtcaggccaatgcccgccagtttttcccggatgcggttgatattgacgctcaaagcattgtcatccacatatagctgattgtcccatagataatctacaatatcattacgggaacaaatctttcctgcgtgtttgaaaagataatataatattttcaattcattctttgtcagttctgcttggttaccgtcatattcaatcgtgctactttctaagtgaagaatcgctccttgccaattcagacgctcaatttgttctatcgggtaagctcgtttcatcaaggatgaaatctttgccagcagaattgctgtgttataaggcttggtgataaaagcatctccacccagcaaaatactgttcaattcatccatgtccgtattgcagcttgttacaaagataatcggtacattggaaaaactgcggatttgagaacagattgagtagccgctttcttgtggcagctttatgtccagcaaaatcaaatagggatgagtatttttgaccgcttgcataactgatgtaaagtcagtaactgcggatgcctcatatccgtttccgtttaacagaacttgtaattcagtttgaatgattgggtcatcttcgatgatgagtattttatatttttccatgattacatgtccctttctttgaatatttagtaccaccaaggcagttccagccagaagttatccagagccaatttctccgtggactttgctctgctctctgacagatggaagtgcttcgccgtttcgctcagaggatggaggacatcgtcctcaaagccaaagcgataccagagataggctttctctcgctcatcaatcatttccagagccgtatggatttcttcgtgggtttcctttgcaatgaaaatctgctctgggttctgtactctggaatctgctataaattcatgttgtcccttattctcgccctttttgacctcatccagacgaatgatacagtccagatttttggcttcaaaggtaggattcagcctgcggatgtagtccagcatggcattatgaatagccggggcagcataggtcaaaaacttgttcccgtagtcgggttgaaagctgcttatgcagcccagaagccccaatgaaccctcctgcaccaaatcgttcagttcaatgccgagggcaacgttcagctcccgctgtgcgctccatatctcgtatgccgtctttcggataaaccgcagattgttctctacaagggcgttttctgcccatttgtcaccgctctgcgccgcaatacagagctgctcgttagttatcttgtccatcatcttccggcagcaccatcgtctgcatcagccccagcaaggctttgttaaagttgtccagagcttcctgattgactccatcgacaccggaaatgctgcctgtaatagcatcaacaactgcttccggcgtgatggtcggattctgcatatcctgccccttggtcagctcggcaaacatcttttcggtggcttccttgctgattgccttggctgcgaccaaatcgctgcctgcttctttcttgatttccttaaccaccgtcataaaggtgttttgaatcgtggtctggtctgcctgataagcgggaattttcatggcattagcggttcgggctgcctgtactgcttcgggagcttggttctgtcccaacagcagagagccaacggtagcaaacatctggttttgtgcggcatatcctcttgcaagggtatcatccatatactgtgcaatcatataagtaaccatggcaaagcggggattttccagcagacggttgactacatcattgttgacctttccggtataaagattctttgcagcttcaacagataatcccagttctgaaatatcgtagttctttttatccgggattacggtcgtacccaagataaagtccgtggacacattgaacactctggcgatgcggataacgctttcttcgctcagcttttcggtctttccgctaaggaagcggctgatggtgctttcattcacatcaatccgaagtgccagttctcgctgggtcatcttgcgttctctcattacatcaacgattcttttccgaacatcggcgggtaaataagtatcagccattatgcttcctcccctctgtctgttttctgtttgatatattttccgcttttaatgcgggcatctgtcggcttttcagcgtcctccgggatgatccagcggcttcctgcccgctgtgcgcccggtatgcggtcattgttgcagaggataccaactcttcggggagagataccccatttctcggcaacttcaaatgtagacaggtatttcatttctgtatcatccctcctgattcatattaacttcaattatattctatttacggaacaatatcaaccaactttgtgtgaacactgccgtctcgaaacttgcattttttcaagttttcggggcggctttttgctttgcttgcggaagtgcctgatttttcggttgaaagcgtttttctgcgtatattcaggcagatgaaaaaatcatcgagaaaaatcaaggaggttatgcaaatgaacatttttgaaacagtcaaggcggcggtcacggttaggcaagccgccgaacactacgggctgaaaatcaatcgctccgggatgatttgctgccctttccacgatgacagacaccccagcttgaagctgaacgaggattacttctattgcttcggctgcggtgccaagggagatgtgattgactttgtggcaaggctgcttgacctgtctgcctatgaagcagcgcagagactggctgcggatttcggactggacaggccgccgtccgtggtggcacaggtaaagaagtaccgtccccgtgtgaatcagtcgaaacaggacgagcttttctgcatgaatgtgctgtccgggtatcttcatcttttggaggactggaaagagcgatatgctcccgaagcaccggaggacgagccggatgagaggttcgtggaagcttgccacaagctggaatatgtggagtatctgaacgatttgctccttatgagcgatcaggaagaaaggactgataccgtcaaggaacttttgacagacggaacgattgcaagaatgcaaacacgactggacgagcagaaaaaggaggtgcgctgccatgtcagagaacaggaaattgcttgagatgaatgtgccgatgtggtttgacggcaagagtatcaatgaagctctgttttgtgaagattttctgagaacccgtcagattatctttgcaaacggagcttttttcacacctgatggtcgagtgacggacgacctgccgcttcgtggcgaaatctttgaagaattgaaatattgtgccgtgaacaacattccccgcaaaatcagcaacatcattgagattatgaagctggcggctcatgtggaggacttcccgccggagcaggacaggattcatctggcaaacggtacgctcatgctggacggcacttttacagaggggaagccggatattgtgagaaacaggctcccggttttctatcgcccggatactccgaaacctgtgctgtggctttcctttctgaatggtctgctttacccggaggacatccctaccttgcaggaatttatcggctattgcctgattccctccaataaaggacagaggatgatggtcattaagggcaatggcggcgagggtaaatcccaaatcggtgcggtgctggggcaaatgctgggcagttccatgaaggacggaagcattggtaaaatctctgagaaccgatttgcccgtgccgatctggagcatatcctcctatgcgtggatgatgatatgcgaatggaagccttgcgccagaccaattatgtgaaatccattgtgacagctcaagggaaaatggatttggagcgcaagggcaaacagagctatcagggctggatgttcgcccgtctgctggctttctccaatggagatttacaggcattgtatgaccgaagtgacggtttctaccgcagacagcttgtgctgaccacaaaggaaaagcctgccggaagaatggatgaccctgacctcgcccagaagatgaaagctgaggtggagggcattttcctctgggcgtttgagggattgcagcgtctggttgccaacaatttcaaattcacggaaagtgagcgcaccaaaaccaaccgagagtccgtcaagcgtgacaacaacaatattttcgacttcatggagtctgagggctatatccggctgaaagcggatgcttccatcagctccaaggagctgtacgaaatttatcggatgtggtgtgaggaaaattctctgccgcccctgaaatcccgcagctttagtgacagtgtggtggcaaatttaagtcgctacaatctggaacacaccaacaaaatcacaaactctgccgggcgcagggtgtggggattcatgggaattgaagccgtagcccgtccgaatataaatgggttttacgacgtttcgccgtgtacgtacgtaccggaggaatggcgggattgattttttggtacgtacgtacacagcgtacgagcgtaaatcactcctgtataaaaccttcgtgacgtacccaaatgacaggaaaaagtcagtcttttttctgtcaacggacggggcggtttcgcaaaacagcagccgtccgtgccggacattggaaagaggagcagacaactttctgatgttcggcagaggtcgccgcagcgaccgcattaccctcggagagcccctcgggagagcccacggcactttgcagccagtatggatgaaagtgtcatagtgggttattacacttccgcagaagtgcctttccaaagctacctgtctgcaaatcccaaagaaaggaaggaaaaatatggcaagaaatgacggagttgaccgtacctgtgcaagaaatatggatgtcacagataatgacatcggagatgcacaggcacacaatgagcgtgaaaaagaaatatacagtaacgaagatattatcccggaaagaagttccctcaacgtacacttcaaagaacctaccgggagctacgctgaaatgtttgagcagatgaaagctgacaacatcatttccaccagaggtctgaaggcggatgccgtccatttcaacgaaatggtctttgatgtgaactctgcgtacttcgacaatcacggcggttatgaatacgccagacagttttatgaggaagcctataaatccgctgtggagattgttggcggtgaacagtatatcctctcggcagtcatgcacgctgacgagattaaccgggcgatgtccgaagcacttggcaaggacgtgttccattatcatcttcatgtggtctatgtccctgtggtggagaaacagattttgtggtcgaaacgctgcaaggatgaagctctcagaggaacggtaaaggaaaccattatgcaggtcagccgcagtaaaaagtggctgtccaaacctgctgtggacaaagatggaaaaccaattctgcaagtcaatggtaagcctgttctccgaaaatcctattctgttttacaggatgatttttttcagcacatgagagctgccggatataccgatgtggaacgtggagagcgtgacagcaccgaggaacatctgactgtgacccagtttaaggtggcaaaggaaaagcagcgactggaagctgtgacggcggaactgaaccagaaagaagcacagcttgacgatactacacaggctgcggagaagaaaaagcaggagcttaaatccctgcaagcacagactaaggcggcaaccggaatagcggtgacggttcaggagctggagtcgatgggtaagaaatcttttaccgggaatatcgtcttgacacccgatgaatgccgtactctcaaaaattatgctgtcagcagctttgctgaaaaagcggagaaattaaaataccagcagaaatatgaaacagccaagaaagatgctggggtatggaaaaaacgatatgagaaacttctggaacaggctcagccgtatctggatgctgtcaagctcgcacctgaaagggtacgggcttttcttaatgccgttttgaccagaggaaaagagaaacaggacattccgcaggaacgtggacgaaaaagaaaggagagcactattgacagataaatggaatggttttgccgatttacttgcaaatttaatagaaaaatatgcggcggttctggatattgataatcttccagagccgccgtcttgtttggaggaagaaaacacatctgaagaacccagtgacactattgaattgatggaaaagcaatgatataatagtcgtggaataagtgtccaaactctatgcgagagctactgttctcaacgcatagagctacatagaataaaagcgcaataccccgttgcacaattagaaatgaggtgttccggtgaacaattatgatgatatgaatcaaaaatccaatatgattatttacacaacagaagatggattgacaaaaattgaaaccacatttgatgaggataccgtgtggttatccattgaccagatggcagagttgttccagagagataaatctactatttcaagacatataaaaaatgtattttccgaaggcgagctgcagcgagagtcagttgttgcaaattttgcaacaactgcggcagatggaaaaacctatcaggttgactactataatcttgatgttatcatttctgtcggctatcgtgtaaaatccaagcgtggcacacagttcagaatctgggcaactaacattctcaaagaatacatgaaaaaaggttttgctttggatgatgaacgattgaaaaatctgggcggcggtggatatttcaaggaactgcttgaaagaatcagagacatccgtgcatcggaaaaggtgttttatcgtcaggtgcttgaaatctatgccaccagcattgactacgacccgaaagcggaaatctctatccgttttttcaaaaaggttcagaataaaattcattatgccattcacggacagactgcggcagaagtgatttatacaagagcggatgcggaaaaagagttcatgggacttaccacctttgccggtaatcagccgacactcaaagaagcgattgttgcgaaaaactatctgaatgagaaagagcttcgtgctatgggacaacttgtatccgggtatctggattttgcggaacgtcaggcagagcgtgaacaggcaatgacgatgcaggactgggcagagcatctggatcgcattcttaccatgagtggagagcagcttttaattggaaatggaagcattactcataagcaggctgttgataaagcgactggagaatatcgaaaatataagacaagaacgctcagcgacgtggaaaatgattatttaaattcgataaagatgttggaacagaaaactgacggcaaaaaataacagacgatgaaagctgaattatgccacaggctgtggcacaaatgaggatggcgatatgaaagaaaaaacaaaagtatatatttatacgagagtatctactgccgttcaggtagacggttactccttggatgctcagaaatcaagaatgaaagcctatgctgagttcaacgattttgaaatcgtcggtgaatatgaggatgccggtaaatcgggaaagtccattgagggcagattggaatttaaccgcatgatggaggatatcaagtccggtaaagatggcgtgtcctatgtgctggtgttcaagttatcacgttttggcagaaatgcggcagatgtgctgtctaccttacaggtgatgcaagatttcgatgtcaatctgatttgtgtggaggatggcattgattcttccaaagatgccggtaagctgatgatttccgtgctttctgcggttgccgagattgagcgtgagaatatccgtgttcagacgatggaaggcagaatccagaaagctcgtgagggtaaatggaacggtggttttgctccctacggatacaaattggaaaaaggtatgctgtatatcaacgaggaagaagccgaggcaatccgcattatctttgaccagtatgtgcataccgatataggagctaacggacttgcgaaataccttgccaatcacggtatcaacaaaattcagcggcagaatggaaaaaatcctctgtttgatgcagccctgattcgcagaattttgaaaaatcccgtttactgtggtaaaattgcttacggcaggagaagaacagaaaaggtacatggaactcgcaatgattaccgacttgtggagcaggaaaattatctgttagttgacggtctgcatgaagccattgtatcagaaggactctggcatgaagcccaagtaaaacttcttgctcaggcgaagaagtatgaaaaggtcaacaacggtaaagacaacaaggtacacctgctgaccggattacttaaatgtcctatttgcggagccggaatgtacggcaacaaaagcatcaagcacaagccggacggcacgaaatataaggatttcttctattatggctgcaaacaccgcactatgacccgtggtcataagtgtgaatacaagaagcaaatcaatgaggaattgctggacggtgctgttgcagaggttattatcaaactggtcagcaatccgaagtttgcggcgatgatgcagcaaaaaatcaatatgaagatagatacatccgccattgaacaggagattgccaattatgaaaaacagcttcgtcagagctatgctacgaagtcccgtttgattgatgagattgatacccttgacccagatgataagcactacatcaagcgtaaagcagaccttgatgatcgcctttataaaatgtatgataagatagaggatacggagaatctgttgattgaagccagagcaaagaaaatggcaatagaagcagaaaaactcactgctgacaatatctacaaagtgctgatttattttgaaaagctgtacgctgtcatggacgagcaggagaagcgacagattatggaatcgctgatttctgaaatccatatctatgaggaacgacagccaaacggtcagtggctcaaatccatcaaattcaagcttccgattattgaggaagatatggaaatgagtttggacagtgatacacatgtcgagacggcttgcttgctgtcaagaaaaccgcagtaaatcaaagagtttcgcgatttcagatagatatgagaatgtgtttttgtttggttggatcgatatttgtttggtattactgaaaggggatgaacattttagcaaaaggttagaagtttattgaagattaaagtagagagacgctaacatggatatatattgtcggagaaaggaacaaatacgttgattcagatagagttaatagactatgattctttaacaagtatcggaatgaaagtaactcaatatgttaatagtaatttaaaagatataatttgatttttcaattaaatgataaagaacgtaaggaagtggcagcacttgcaagaaaaaataggaaatgcgagtagtgttagaaactgtaggtaaaatagatagtcaaactcttgcctaggcgagataaaagagaatttttgatagtgagtataatagtaaagttgcactgcttgtgaatccattgtcctgttgcagcgtgtggaaacagtcaaatggaagcaccttatgaatatcattttttttaatatagaggactttaggaggtaagaggagacttggaaaaatcaaatattttaatgtatacgacggaagatggagtcacaaaggttgaagttacttttgatgatgagactgtatggttatcattagatcaaatagcagagttattccaaaggaataagtctacgatatcccggcacattaaaaatattttttcagaaggtgaactaagccgggattcagttgttgcaaattttgcaacaactggagccgacggaaaaagatatcatgtggatttttataatctcgatgttattatttccgttggttatcgagttaaatctttgcgtggcactcaattcagaatttgggctacaaatgttttaaaagaatatatgaaaaagggctttgctcttgatgatgaccgcctgaagaaccttggcggtggaaattattttgatgaattgttggcacgtatccgcgatattcgttcttcagaaaaagtattttggagaaaggttttggaaatttacgcaaccagtattgactataatcccaaggcggaaagctctgttttgttttttaaacaggttcagaataagatgcattgggccgcgcataagcatacagcggccgaggtgatttaccagagagcagatgcagataaggataatatgggattgacttcatggagcggaaacagcataaaacggtctgatgtagaagtggcgaaaaattatctggatgaaaaagagctggatgcgctcaataaaattgttgcggcttatttggatattgccgaggtacatgctttgaatcaggaacctatgtatatgaaagattggttggagacgatagatgattatctaaagatgaccagacgggatatcttaaatacaaagggaaaagtaacacatcagcaggcattggagaaggcacattctgagtatgagaaatataaaaaaaatcaggaatatgtattgtcccctgtggaatgtcattttttggagagtatagaggaattggataaattggatggaacaagtaagtaacggaatgttgaaatatggtttcctccaaagggaagttataccttttcgacatcattatcacccactcgacacatacggaaagtattgtcctgttgcaaaagagtgttaaatgatgattaggtgagattggatagttgtcgtgtggtgaggcgtgaaggcttttggctttcgcgccttttccttatggatgagacgaggtggggtgttgtgaaaaagatatattatatacctgtgaaaaaagagaatacggaaccgctgcgtgtggcggcatattgccgcgtcagcactaagaaagagacgcagttagccagtttggctcatcaaattatggcttatacagaacagatatcagatcatccaggttgggtattttcagaggtgttctgggattgtggaagaagtggattaaggaaaaagggccgtgacggattgaaacatatgttagaaagtgcaacagaggggaaattcgattacataatcactaaatcagcaaaacgagtatccaggaatacggtagagctattgcagattatgagatatttgaaagaaagggggattcaaatgtattttgaaattgaaaatgtgaattcgtttgatccggatgcagaagcggcaataaccttatcaggagcaatgggacaagaagaaagcagaaacttgagtgagaatattcagtggggtattaaaagaaaatctgaagaaggattatttagcagctataaacattttatggggtatcggtgtgtggaaggggaattggtaattgttcctgaacaggctaaagtagtacgattaatttttgagttatatttgaggggatacacattttcacagattaaaaagtatttggaagataatggtataaaaacggttacaggtaaagaggtatggagtgcaaatgtaatacaacaaatgctaaagaatgagaaatataagggagacatgatgcttcagaaaacatttacagaggattatctaaatggtatacgaaagaaaaatgtaggacagcgtaccagatattatgtaaaaggaagtcatccggccattatttcttcggaaatatttgataaagtgcaggcagaaatgcttaatagagccagactgctcagaacagctgacggcaatcagattagcagtggtaaccgatatagcagcaaatatttgcttagtaatttattggtatgtggggattgtgggggaggattcaggcgtagaacggagcgtgggaagattgtatggagatgcgggacaaggatggaaaaaggaaagacggagtgtaaaaattcacctaccttgaacgatcaatatgtaagagatatgctgggaaaagttgtgtgtaatggggaatatgatgaaaatgtcgtaaaggttagagtgaagagaatagatgtttatgataagcagttgataatttgctatgctgaaaaagagagatatcagatgtgtgaattataatagatagttgagaatgttattttgcatagggataaataaacggaaatgcagaaatcttttagatggtaatagcgaggggagtatgatactattttgtataggagatttggctgatataggttgattaattttagcgtttttaccaatattgtgtttgccgaatagatgtccctgaaatattgtgctaacctagtgtgccatttagctagaaaccatagtatcagcactgttattatagtttctgactgtatgagtactaaacgatggtggatttaattagggaaaaggtaaacaagggagatctgctttagatatttacaaggcatgaaatataggtattatgtttaagacatgattttatgaataagtagtatttataataatttgagaagaaatttatctaatttcggtaattgagatgatgttcaagagaagggtgattatagatggagtacattaatgggtatcgagaagagcaaagtttgctgacaaaagacggaaaggaaatacaggttcgttgccttgaggtatcggagaatgatgcagtgcttgatgagtgggcagctcattttcgggaacagtatcgttacctagatgctctggatatggaaagagaaggaacggggataagcagggaagaattcttaagagattatgttttcccgggacaagcaaagccgggacccgcaactcgtgtaggagatttttgtgagattcttgtggcagattatatcgaatatattcagagttattatgtacccagaatccgataccgtagtaaatttaatcggaacacatcaccacaaggcagtgatgtgttagggtttaaattagggacaacaccatcgccaagagatgaagcgattatatttgaagtgaaaggcacgtctgatccaaaaggaaagaaaaagggtatgaaaggttgcaggaggctattgatcattccaataaagatgtggctagatatgctgaatctttaaatgcagctaacgaaggttcaccaggccaaaagagtgcagctattttggcatttattttgaatagcggtgagaatccattaattattgatcagccggaagacgatttagacaatagtttgatttattcgcttgttgtaaaatctataagaaaaatgaagagtaagcgacaaatcattattgttacacataatcctaatattcctgtgttgggcgatgcggagggcattgttgttttgaaacgtaataatcagggaaaagtcacttttagaaaggataaaaaaactggctgcattgaagaaaaaattattagagaaggaatttgtgaaattatggaagggggagaagatgctttccgtaaacgagagcagaaataccaatataagtaaatagagtaataaaaatatgaaccacaacacatggtttaaatcattcgtgttaatgattattggtgatgtactgcaaacgattattatgattactgttcttttgggtatggaggaaaagaattggaaaaatcaagtatttttgatcgaaataaatgagttgaaagatatataaactaataaaaaatacgtaaatatgtggtggtaaaataatgaatttagagaaatcagttgaattggctataaggaatgttatgaaagaggggcttactgatatatttgctcgtccatttgaggtggatcttttatcaaaaagtgaattgtttaaaaaacgaatctatgatgaaacgattagatccattcgttcgggctcggtttcaggactgggaatcaatgctatagattacatgcttatgcctaaaaatattgcttttggttttcgaaaatgtgcattaatacaaccacatgatactattaagtatttagcgcttgttcttacacttgcagaaacaatagaaaaggcacgggttcctatatcacaaaaaagagtgtattcatatagatttcatcctaacaatggatatttgtggaataaaaattacaccatcactgcttttaggaatcgagtaagtgaaaaagcaaagcaaaagaaagctaatctaatagtttcatgtgatatagcaaattactatgaacgattaaatttacatcgactacagaatacattactatcaattaattgtaatcgtaatattgtaaatttgattaatgaattgttactattttggtcaaatcgtgattcttatggtttacctgtaggatctaacgctagtagaatattgtcagaggctaatttaattggggttgacaactatcttctttcaatgggggtagactttattagatatgtggatgactatagattttttgcgcccaatgcaagtgtggcacactattggcttacagttctgattgatcgcttgggacaggaaggcctgtcaattaatatgagcaagacaaaaatagaacctaatgataggtatatgcatgccacggaagttcataccaaaacaaaaaaagagaaggacgaaaaaaatccatttataataaaggcaggatatggtggaacggtaccaacaaattttagaaaaccttcaaatagtgagaaagaaagattagaagtgttaaatatagagggccttttggaaagcgcaaagataaattgtttagtcgagtcttcagaatttattgagattataaaagcttgtattgtacaacgaaaatatagtatgttagtagaaatattagctataatcgataaatatttacagttaacaccttactatatagatacattaatcaaacatcaagagttttttacacttgaggatgttgaaaaaataaatatatattttacaaagcaaataaaagaaagtaggtttattcccgaatatttaatggtttcgtatattagactttttgggagtgattgcttttcaaacaaaaagtttttaatcgagcaatatagaaacttacgtagggattcaggcgcatatgtaggaagagtgttactagatgcattatatggtctggctaaccgagaagatatgcttgaaatacgtaaaagtttttcaaggtcaaatttgtgggaaaaacgtcaaataattaggttaattgacagtacatttgatgaggaagagaaaagaccttggcttaagaatatacgtcaaatagagcctaacgaattatttcttttggaaactgcagagccaacgaaactgaccaaaaagaaaaaaagaaggaaaaaaatatcatcgaggagaattgaagaagaaatataacttggaaaggcatagcaaaggcgaggtggtgaactgagtgaatagtcaaggtgatattaataggaaatcaaatattattatctacacaacagaagatggtttggcaaagatagatacaacttttgatggagatacggtatggctgtcaattgatcagatggcggagttgtttcaaagagatagaagcgtaataggcaagcatgtgaggaatgtttttaaagaaggagaattatctaaagaatcagtatgggcaaaatttgcctatactgctgctgacggaaaagtttatgatgtagattattataatcttgacgtgattatttcggtcggttatcgtgtgaagtcaaagcgcggcacacaatttagaatatgggcaacaggcattttaaaggaatatatgagaaaaggttttgcgctggacgatgagcggctgaagaatttgggtggtggaggctactttaaagaattactcgaacgtattagagatatacgtgcttctgagaaggtattttacaggcaagtcttagaaatttatgctacaagtattgattatgatccgaaagctgaaatatccattcagttctttaaaaaggttcagaataagattcactatgcgattcatggacaaactgcagcagaagttatttataccagagcggatgctgaaaaagagtttatgggacttatgacatttgcaggaaaccagccaacattaaaggaggctgtcattgccaaaaactatctgaatgaaaaagaacttcgggcgatgggacaacttgtttcagggtatcttgattttgcggaacgccaggcagagcgggaacaggtaatgactatgagcgattgggcagcgcatttggatcgtatacttacaatgagtggcgaacagttacttcaaggaaacggaagtgttactcataaacaagcagttgataaagcaacgagtgaatacagaaaatataaaaccagaaccctcagtgatgtggagaaggattatttggattcgataaaaatattggaacataaaacggataagagttgaaaaggtgatattattcacgagttaataaattagcgagtgtgtgaagaaaagtctgtaaaagctaatcttctatgataataactgggctgaaagttctttcttggaccttcagtccttgttatgccggaaacagccggtatacgggcaataaacgggtgataaatgttcacaaaatacttgatttttttcaaagtctgtggtattataatcactgcttatcaaagcaatatctgggcgaattcccgagtggccaaaggggacagactgtaaatctgctgctaatagcttcggtggttcgaatccaccttcgcccactagcgtgccattagattagcttaaggacatcagtgcagtgcacgtaaaggtcctggttttcagccctggcacgtactaaagagtacctgtgagtactttatgcgggtgtggtggaataggcagacacaagggacttaaaatccctcggtagcgataccgtgccggttcaagtccggccacccgcatgtacgaaaaagccctggaatatatttccggggctttttcatgcgttttaacttacggctttctttcctttaaccagcacttcctgaattctgatatcatcatcaaatatgacgacgtctccatccattccaactgaaaggcttccctttctgtcctggataccgagaacctttgccggattatatgtcatcatgcgcactgcatccaccagacgtacctctgcctgatgatacatggtgcggacacaccggtctgcggtacagacgcttcctgcaaaagcgcttcggtccggcagcaccgccacaccgtcatcaatgatacattcctgtccgtgggccaggcttcccagcagtacatgttcaccatcgctcatacctgcccctctcatggaatcagtgacaaggcagatatcctcaatgggcttcatctttacaataaatctaagcagttccggcggcagatgtttgccgtccgctataatttccacggtcattccgtctatcaggtaggcgctttcaatcactcccaggtggcggaacgcgttgattctgcggatggtggacattcctgaatacagatgagtcacatgggtataacctcgttcccatgcctttatgacatcctcataggttgcatctgaatgaccaattgatgccagaattcccctggccttcagttcatccgccagttccatggctccttccagctccggcgccgccgacatgcggatgatatcatccgatgcatccagcagctttctgtagtcgtcttgtgcaggtatctttatgtattgggggtcctgtgcccccctctgttccagtgaaaaataggggccctccagatggatgcccagaagctccggtccatccttcatctgctttttagcttcacggtagcattcaaagaaagccagcagttcctcgtccgtacaagtcagggtagtggggcatatggatgtggttccatgaaccagatgggccctgcatgcccggatgattgcctccggggtaccatccataaaatcatatcctcctccgccatgagtatggatatctataaatcccggacccacatacgccccttcagcatcaatatagcagtctgcctcaggcctcctctccttgacaatacctgttatgactccgtcttccataacaagactggcctgctccatcattctgtgaggcgttattaatcttccattgattattgcagtcttcatggccttctcctatttctttacacctgcggaatgaccttggaagccgaatcaccatccagaaacagattccagtcaggatgcgttttcagtatagttgccggaaccaggttagacactgcttctgctgacaatgccttctgaatcgcatcactcttgcgtataccgggtacaatggtaacaatggtgcggctcttcaatatctggggtacggtcatggatatagcctgggccggcacatcatccagagtcgggaaccacccttcatttacctgctgctgcttacacttctggtccagatttacaatgatataggcccggtccgtttcaaaatcagcaggagggtcattaaatgcaatatgtgcattttctccgattcctaccagagcaacatcgataggtgcctttcccagttcttctgtcagaacagcaatattttcctccacattgccctcgccgtttacaagatatgccttcttggggttaacaacctgtataaagcgttccttcagatacttgcggaaactggccttatgcgtctccggaagattgatgtattcatccagatggaacatgaccaccttatcccactccacttccatctccgtcagatatctgattgactctatctgggactctcctgtggacaggagaattctggcctccccgttttgtgcaatggtacggttgattgcctgtgccgcgcatgctgctgctctttgtgccatctcacttgatgttctagaaatattaatgttcataatcaacccttctcctttaatccgaacttttcattgcagatattaatattcaatctctaatatcctgcctgcctcagcgctcatatgggcatactgacacattatagtggacacaattgcttcttctcctgtgggatacagtccttccagttcttccagggtagttccctccttcatgcggttcaccagctgaaggaaaaacagcatggactcaatgcaatacccggaaggtaccggacccgccaccgggtcatctatcatcatgtttccatagggattcaccacatggctgtaactgtcagcattatatgcggccacaacgcccctgtcctggctgtctacttcctggaatccttctgtgcccaccagacgaatctgctggttcacaatggatgaaaagctgtttggaagtatccaggatgcatccaccgtaatgctggtcccgcttgcaaattcaaacttggactgaagggaatcatatgtatcaatgcccatggatgtaagttttttcttgattccggaggcatatacccgcactggtttttcgcccaaaagccagtatatcaggtcgaagaaatggatgccgataaaccaggccggcgaactgttctgcgcccagtttttaaaccagaccgaaggaaccagaatcttgtcctccatacacacatagccatattctatttctcccagcctgccttccttaatcgcattccgcagctggatatgggccgggtcaaagcgcttatggaaatccacataaagcatgacattattgtcctttgccgcctgtatcatccgcttaccctgttcaatatccgtagatagaggtttctgggccagaatatgaatctttcttttagctgcttccagaaccacctcctcatggagataatccggtgtgaccaccgccactgcatccagcccctctttatcaaacatttccctataatctgtgtaccctttaatgccatacttttcattcatggatttgagcgtatccgggttgatatctgcaactgctgcaaattcaatctctcccctcttatgcgcaccatagtatgcgttaataagaacactgccataggttccggctccaaccacgccaacttttgctttcatttatatttccctccataatctaaatattctttatcataatgcttgttatattatacgtaaccaaacagtccgggcaggaacatggtaatgggctcaatataggtcaccatggtcagggcgatgaacagcggaatgagccagggcgataccatttttaccacgtcgccaaaggaacgcttggatgccgatgagagcatatacagagacattcctaccggcggagtcagcagtccaatcatcatgttcagcaccagaatcacgcccatatggatagggctgatatttgcaatagccattaaaggagtcagaatgggcagcataatcatgattgccgctaccacttcaataaacatccccaaaaccagcaggataaggttaaccagcagcaggatgacatagcggttggatgtaaccgaaagaatcagctccaccactaccttatcaatctgctcataggtcataacccaggcaaaaagggacgcccctaccactactgcaatggatggtcctacctgacggaccgtggccactgccagagacggaagcttgcgtatatccatttccctgtacacaaagcaggatacgattgtgccatacagcacgctgaacatagctgattcagtaggcgtaaaccagcctgtccatattcctcccaacataatggccgggaacatcagggccggaagggcttccagaaatgccttccatttttcacgtccggatgcctttgcatgtctgggatattttctctttctggcgataatatatatatagatacataaaacaatacacaggacaacgccagggccaagacctgccataaaaagggctccaattgacacatttgccattgctccatatataacgaacggaatactgggcggtatgattggacccacggtgctcgaggcgcctgtaacgccaagtgtcaggtcgtcatcatatttctcatccctcattgctttgatttcaatcattcccagcccgcccacatccgccagggcggaaccgctgataccggagaatatcaggctggacagaacgttcacatatgcaagtccgccgctccaatggccaatcatcttcttggcaaaaccaaatatacggtccgtgacacccccgttgttcatgacctgcccggcaaagataaagaaaggaacagccaggagtgtaaaggaattaggcgcattcatcatcttattcatagccgtcatcatggacagctggggcgtcagataaatgtacagcagggaagaccctaaaagacacagatacataggcgctctcataaccatcagaatcaggaacaccagaaagaatactttaatcggctccatatactcctactcctcctttccattcagatttccaattttccggacactgtttacggcatttaccagacagcggatggagcccaggaaaaaacccaggaccattcccgccgccaccactgacatggggatttccatggcagcggattttaccaccttctgaaattcaaaaaactgaacggaccagtacagcaggtaagcgtgaattccaaagcagaacaggcttgtaagtgtccggaggagctggtttggtactcccttaacaaatgaaagaaagacctcaacattgaaatgctcaaatttcttctctcccagggaaatgcacaggaatacgacccatatgtaacaaaagcgggatatttcttccgaaaacagcagcgctttcttcagaaagatacgggagaacatctggcacaggattgtaatacacatgacgccaaataaagagcccgctataatctcctccagggagttaaataccttcaatagcttcttcatgcttacctccgttgtttcactctgtcagcaggtttcattattccttccaattggccttaaagtcattcaggtccttgatggccgcggcccattgaggatcacttccgaagttctcctccaccaccttggctgcgttggccttaaatgcctcaatatccggttcaatgaccttcattccctgttccttaaggaattccagaccttcttctgtctctttattgattctctcctcaatgatagggcggtacttcgcaagcacatctgtaatgacctggcgctgctcctctgtaagactctgccaaacctgctccgaaacctccaccgtaccaagatggacggaatgctttgtcagaacaattgcatcctgcacttcatagaacttctgggcaataattgtgggaacagggttttcttctcctaccacgacgccagtctgcagtgaaaggtataattcactcatattaatggggaccggattgccgcccagagcagccaccacggttttggctatgggcgtgtccatacagcggacggaaagacctgacaaatcatccggtttcatcggctccacgcctttgattgtcagatttctgtccccgtaataccatacatccaatgtccgcacaccgcttgcgttaaggactgtctcattgtacattttctgcgagccttcggatgcaaaatagtcataggcctgttttacattgtcaaacgcatagggcagcgagtatacctggacctggtcgcagaaggatgccaggatgcttggacctgtgacctcaaaagccagagagcctgtacgcagcatatccagcgcctctgcctgtgtgcctaaagtggctcccggataaactttgattttaagggctccattggtcctttcctcaatctcctttgcaatatcataggaaacctggctccacgcatggctttcaggctctcccagataccaggacaattcaagtgtttcgcctgccgccgcctcacttgcggtatcctcagccttgctttcttccgctttggcttccttggtatcggctgccgcaggggctgctgtggatggcgtctccttctgaccgccgcaggctgtcatacttcccgcagccatcatcactgccagtgccagacctgccatcctcttggttctttttctcatcttacatgtcctccttttaataaaatataattatggtggttatatgcaccccagtcatcctgtgatgcacgtatgctctctgctttctcatatccgttttttgttttgtaagctcattatattatagaaaacgttttctgtcaatatttctacaaatatttttattttcacctttatttttcaacattttcacgttgattttctatctatctccatttattcttgtcttaattttctattattttcttctttttctattgcttttctatcatttaagtattatcatacatatatatgctttttcataatctgattttaaaggagatacatcgtatgaatcataccagccataatgttaccataggcgacgttgcaaaggctgctggtacttccgtttctactgtttcccgtgttttgagcggcagcgattatcctgtcagcgctgccaagagggaacgtgtactgcatgctgcaaacacgctgggctacgagccaaacctgcttgggcgcatgctgaagacaaataccaatccctccataggaattatcatcccctctttccagaatccgttctacacccagctaatcatagggattgagaaagaggctatggcaaataattattttccattggtattcagttcacagagaagtccggagaccgagcgtaatctgattaacaatcttataaaaaacagggtaaaagggttgatgatttcttctattgacgactctccccaggccgtggagcattttgtatccaccggcgggaaggtgtgcatatttgaatccaactactctgacacagacaaggtcataaacgcaaagacagatatgctgggagccggacgcactgctgccgagtacctgatatcacaggggcaccggtcaatcgcatttttaagtactccgtttaaccgtcagtcacgaattatgaccctggacggctacaaactggccctggcgaacaatggcctttcattttccgaagatgatgtaatgacagtccagtatgaatccgaagcggattccggactatatgagatggaagccggccataagctggcagacaaattcctggaagcgagagcaagaaaagaatacactgccatcatggcagtcaatgatttgattgcttatggaatcatccagcgcctgcaggaaagagggctggggatacccgatgatatttcaatcgtatcatttgataatatcccctattccgggctcatcaatccgcctcttaccaccatggacatgcctgccagattactgggacagcgggcctgtcatttaatcattgattccttaaattcaaatgaagaccataacggcattactctgtcagtcagcgccgagctggtcgtacgcaaatcagtaaaagccctgtgaccgccgtgccctccttcataaccataataaaggagatagctaatatggattctgcattatacaatgtaatcggcaacgttaagatacccaaaatggcccgtgtgcgccagaagttcgacccatccgaaatcgcggacccggtactggaggtgcgcagggaacttagccgtccggagatagcagccgccattaagccaggcatgaacatagccataacagcaggaagccgcggcatacataatcacaagctgattctgaaagcagtggtggatatcgtcagggaacacggggcgaatccatttgtgataccggccatgggaagccacggaggggctactgcccagggacagctggaagtattggaaggattcggaattacatccggctatcttggctgtcccattaagtccagcatggagacagtcaggataggagccagcccggcaggccatgatgttcatattgataagaatgcatgggaggctgacggcattatcgtaattaataaaatcaagccccacactgcattcagaggctcctatgaaagcggcctcatgaagatgatgaccattggtttaggcaaacagtatggggccagcctgtgccatcagtccggtttcaagaatatgggacgtctcgttcccatgttcgccaatgtcatcctggcaaactgcaacgtcttattcggtctgggcattgtggagaacgcttatagccgcacacatatgttaaaggcattgactcctcaggaaataccggaaaaggagccaggtcttctggtactggcccgttcattgatgccgcgcattctctttgacgacatcgctgtattagtaattgacgagataggaaaaaatttcagcggcgacggccaggaccccaatgtttcttcccgctttgccacgccctatgcctccggtgattttaccatacaaaaggtatgtgtgctggacctgtcggacaaaagccacggcattatgattggagccggctgcgcagatacctgcacccggcgtctggtggataaggccaatctggaggcaagctacatcaatgccataacctccactgtatttgactgcgtacggcttcccatgattcttaaaaatgattattttgccatggctgcctgtatcaaaacctgtaatgaagtggatataaatcatatccgtatggtgaggattcccaatactctggagataggtgagatatggatatccgaaagcatgatggaagacgcccggaagaatccgcagatagaaatcatcagccagccccaggaactgccctttaatgaagagggaaatctctggtagtttggtaccctctgcacagcaaaaaaagagcacctccccgcccgcggaacaatccccgcctccggaaggtgctctttcctattcaaaatccatctgtcttacatcatctgtctgtgcgtttcccgcctacttctccacagccgctgccgcgtcatccgcgaaccgggaccccaccacaggataaaactcatccggctgtgatacgaacacggctgcactgtaaggcggcatgttcagcttcagagttccgtcctttacacggtagaatatgacgcctgcattatatcctgtctcggtggtcagtatgggcctgcccagcaccatgtcgtcggtaatgcccagctgccataccggaatgtccatggtctggctgtccggacagttggatatcaccgccacagcctgatatttcccatacatgcgcccgtatgcaatcttctggtatccggccagaagcggcttaaccgcaccctttctgaatacagggatattgcggtgtatgccggtcatatagcggtggaactcaatgagctccaggtcctcttttccccatggataagtgcgcctgctgtcagggtccgtccacccgcagacgcccgcctcatccccatagtaaagggtgggggctcccggccaggtcatctgaatcaccactgcttcccggaacacacagggctttatgttctgccccgccttctccggtccggcagtctggatacggcctaccatctgattggtcctggtaaggaaacgggaatggtcatggttggacagctggttcatggccgtcatcaccgtgttggtctgcatacggctcatatggtatcccatggcgttgaaaaatgcttccccgtctccccatatgcctccgttataactgtcactgtgcttctccatgccggtgaggaaccatgtgaccggttccataaaggcatcgtaattcatgatggaatcccactggtcgccctccagccaggaagccgggtcaccgtagtgctccgccagaatcagggtctccggattcgcctccttcacagcctgacggaacctgcgccagaattcgtggttatactctgcggtgtgtcctaaatcagcagccacgtccaggcgccagccgtcaatggaatagggcggcgaaacccactttctggccacattcagtatatattccaccagcttctcggaattctcatagtttaacttgggcagggtatcgtgcccccaccatccgtcgtatgtccggttataaggccaggcagcgtcgctgtcgtcatggaactggaaaaagctgtggtacgggcttgccttgctctcataggcgcctgcctcataatccccggaatgctcatagattccctcggcgtccagccacttgttaaaggagccgcagtgattgaataccccgtccagaatcacccgcattccccgtttatggacttcctccacaaacagggcaaagaatgcatcgctggcctccagattctccttgcccgcgctgcgcagcacataccggtcaacctccttgttatccgcggcatccggcctgaccagattccccccatcctttacaatttttgtaaaatgcgggtcaatatgctcataatcctgacagtcgtacttatggttggagggagatacaaataccggattcagatatatggcctccacgcccagtcctttgatgtaatccagcttatcccatattccctgaaggtcgcctccgtagaagtaacccacatccatggtagctgggtaccggtcccattccgttaccttctggaccggacggccgatatagacatactcatatgattccacatcgtttgtctcatctccattgcagaaacggtccacgaatatctggtacatgaccgccccctttgcccactccggcgtatggaaacccggtgtaatcttaaaatcaaaacatggctgaccgtcctgtgtgggtcccagtcggttataaagacagacatcctgctcagataccactttaaagtgataaagcacctggtcggtgcctactgtgatttcatattcataataatcaaacaaatcatcggacatagccttggtcatttccacctcggctttatcctccacgtaatatacatgttccacattgcccttagctgtccgcatgcgaagcagcacatcgtcatctgcgtccggttccattggcatgcggtaatcctctgtctcagaggaaaaaagggcatccctgttaatacgtccctttatattattttccacgttttatatccttttcctaatttgctcatacttatataatcctgttcctttattgtatctgaattttctcaaatatacaagaaaaataatatcagaaaaatcttgataacattacgccttttccatggttttctcacaaagtgaaaagcctggcggggtagccaggcttttcaggagaaggtatttcgtttcttatggggtgtagcaaaaactatataatgtattgggggggttacgtctattataatagcataggaatgaaaaaaagtgtgcacaaagatgcaatattttccaggccatttatgagcaatatagacaagggagggggatttttcacttttctccccctcccaatgctgtttttcttcatctgcagccctaaaaacccgggccggccatactactgcgccggtgtaaacagcgcctcaaactcagtctggctgattttctctttctcaatcagcaaatcagcgcaggcatggaggacgtagtcatactctctgatgatgtcctttgccttctgatagcactcgtcaatgattcgcttaacctcgctgtcaatggtgtcagccacctcattgccgtaggttttggtgtgggccaggtcccggccgatgaatacctcattctcatccccgccgtactgaatcatgcccaccttctcagacataccgtactgggtcaccatggccctggcaatctgggtggcctgcttgatatcctgggatgcaccggtggtgatatcgtcaaatatcagctcctccgcaatccggccgcctaaatccaccataatattctgcatcatacggcccctggtgttaaacatctcatccttttcaggcaggggcatggtatagccggctgcgccgattccagtggggatgatggacacggtgtgcaccggtcccacatccggaagcacatggaacaggatggcgtggcccgcttcgtggtaggctgttatcttcttatccttctcagatattaccttgcttctcttctccgcgccgattcccacctttacaaaggcccggtctatatcgctctgcttgatgaacctgcggttatccctggcggatataatggccgcctcattcatcaggttttccaggtcagctcctgtgaagcctgacgtggtctgggctacccggtgtaaatccacatcctcgctgaggggcttttccttggaatgaaccttaaggatttcctcacggcccttcacatcgggccggcccaccgccacctttctgtcgaaacggcccggacgcagaatagccgggtccaggatatccacgcggttggtagccgccatgacgatgatgccttcattgacgccaaagccgtccatttcaaccagcagctggttcagcgtctgctccctttcatcatggccgccgcccatgcccgtacctctgcggcgggccactgcgtcaatctcatcaatgaacacgatacagggagaattcttcttggcttcctcgaacaaatcgcggacgcgggaggcgcccacgcctacgaacatctccacgaaatcagaacccgaaatggagaaaaacggaacgcctgcctcgccggcaaccgccttggcaagcaatgtcttacctgttccgggaggccccaccagaagaaggccctttggaatcctggcccccacgctggtatacttctgcggattcttaaggaaatccaccacctcttccagttcttccttttcttccaccagaccggccacattggaaaaattaaccttgctgtcccggctcatcctggccctgctcttgccgaaattcatcatcctggcgttggcgcctccgcctcccgcgctccggttcatgaccataatgatgatgactaccaccacgatagacagcataaagggaagaatgatggtcaccagatagttctcctggggcacatccatggtcgtataagccatgtcatgggcttccagtaacgtttgggcgtccttaacatctgaaacataaagccgctttacctgaccgtccataagggtcagcaccacttctcccgtgggagtctgcggattctggtggatgctcacgtctgctgcctggccatcctccagtatcttgataaaatcctgatttgtaaccttatccgcctgccttgcgtaagggaatctcactgcggtggcgattaaaatcagcatcaggagtataaatataaatcctctaaatgtctgctgctgtctcaccgaattgcctccttagaccttcttattctgcatccaattctactactccgatgtaaggcaggttacggtatttctggtcataatccagtccatatcccactacaaattcatccggtatcgtaaagcaggtatagtccaccttcacctgcttcttcaccctgcgctccggcttatcaagaagtgtgcacagatggatgctctttggacctctctgtttcaacacctcaatcagatatgccaatgtacggccagagtctataatatcttccacaatcagtacatccttgccttccagggactcatccaggtcctttacaatcctgaccacgccgctggacacagtgccgccgccgtagctggacacggacataaagtccagggacaccggaaccgtcatcctctttgccagctcgcaggtaaagaataccccgccctttaatatgcaaatcatgtggacctgctttcctgcataatcctcgctgatttttgccgctacttcgttaatccttttatcgacttcctcttccgtcaataaaacacgaatcctgtcagccattgccttatcctccgtttcgcctattcttttctctctccagtctggcctgcctctgcctgcagcacccggattgtatccggtcctatcttgtaatactcgctgatgcggtagcctataatccacatcacatggctgccatctgccagaaggggtatcttatcccgcatctgtctgggtatcttctcatcaatcataaaacgattaagcgccttgtggcttttgtccgccagaacaatatagtcccccggacgcctggttcttaccacgggcgtaccctttattttatcacagtcaaaccatttcgtatacatatttttaggaaattccatcccttttttcagagaaaaaacctccatgtccacgataggcaggtcgccccattcaccttttgccacagggtctcccctgcccatccagattccctcgtactcccttatggcagccagtccgtagggcaaatccacttgctttccaacggcccgcccggccagctccatgacctggctcacatgaaccagccccaggtccctggacgccccgctcaattccttgagaagggacatcaccacataggactgcagaatctccggttcccccagaaaggcccctgccgggatatatgccccggaatccttccttacatgggccttaatccaggcatctgcctggctttccaggtactcatcagcctgggaggccagatgtcccagacgcaggatattgcctgcggcgccccggttcacatactgctctatctccggcagcagctgattgcgtattctgttccgggtgtagtgaagggtatcattggtggaatcctgcacataggacaggtcccggctttccagccacttaaggatggaagcccggtccgcgtccagcagggggcggataatccttcccctccggtagacgattccacgcagtccggaaagaccgctcccccggaaaagattgtgaaggatagtctccacctggtccccgctgtggtgggccacagcaatttttacagggcggaaactgctgtcagccgtactgccgtcagccggaccgccgtccggcccggtccggtcctccccttcccatcccgcagcctctttctccagagcctcatagcgcagataacggcccgcctcctcctcagacatgccctttgcagccgcaaagccgcgcacatctacctttaggatatgacaggggacatgaaacccttcacacaatgacatgacaaaatccgcatcccggtccgcttcctcccccctgagcccgtgatggacatgaagggccctgagccccatttgccacggttccctgaatgcgcataacaacgctaagaggcagacggaatctgcccctcctgaaactgctgcaatgacccggtcccccggctccagcatatgatattgttctatggtctccctgaccctgtgctccagtccttccacctgtctctcctgtgtccaatcatgtttgtctctgtctatttcttataatatacccgcaaatgtccctccttgcaagcctgtggttgtaaattatgagcgtcttttccagattccggctgccaggaccgtcatatcgtcccttggtgccggaataaaagacactgcaaaatccagaacctggtccgccagttcctggggtcccatctcctccacactctccagatactgctgcatagcctgttccttgtcgtcccccggcagcgcatccagcaccccgtcgctgaccatgacaatccggtcgccctcccacagcttcctggacatgagcactggttccactccattgagtattcccatgggaacttcccctgcctccatgatttccacgccctcttccccgatgatgaaggttggcacagcccccagtttcatggcctccagcactccggtgtgcaggtcgatgcagctgaggtccagggtagccggatgctgttccggtcctgccagcaaaagtactgtgttcaccagcttaagggcagcccttggtgaaaatccggtttccagcagctgctccgtcaattccaccacctgcttgctctccctggacgctgcctccccgcttcccatgccgtctgaaaggctcatgaccacctggtttccgggactctcgcagaaggtataattatccccggaatacttctcccccttctttggaattctggaagcgccatagagcatgcggtacccgccttcctccagaaaacgcacggtttcatactgtttggtaataatgctgcggctgtccttggcagggctccaccttgtcccacccataacctcccccataatcagggctgcatccttggaagtgatgcagcggccgttggtggtcctgaccgtgagaaatgcttccttctgcccgttctcatactccagcagcaaaaggttgcccagggcaacatgataacgcttaaaatattttttcagtatgtattcatactcatccgtaatatccctggcacggtcaatctggtgggaaaactcctccagtatcacggacagctccctgaactgggatataaccgcatccctgctctccaggaaccggttcttccaggacagattcatggtggcccgccccaggctccggttcagctgggccagataatcctcctttttccggcagccgctctggaacatctggggcatgtcctcaaaatcaatatggcccttctgctcaaacgcccgcaaaagataatacaggtaatagctgtcctccttctcgctgtccgcatacaggttgcacctgctgcagctctcgcacaccagggcagcgctggcctgcatggcagccagaccatcgtcctttgtcagctgtccgtttttttctataccgtcgtcaaatgccttggccagctggttcagggactctgccatatcccccagtctcctggccgtataataatttacatccgttcttcccttaacttcccgctctctgataaacacaaaaatccctcctaatccgcgtaactttcagtatacgcacccaggagggaaatatatgtcgtatcatgcatggatttttaaaaatcgttcgcctgttttcgccatcaacgaaaggaaatgcgcatcaccccacaggcctgcgtgtcactccgtgggcttcagcagaatctcatccggatttacaagtcccagcttttccttggccacttcctctgcatactgcttggtcttgacgtaaatcttgtattcctgcagttcagcggtccgcttttcttcctctgccttctgctgctccaggttctgttcccggatgctgtactccaggtccgacttcttaaggtcagcgccctttatattgattgccacagccaaaaacatgactaccagggtaatacccatgatggccatgcggttcgtccatttgtcgcgccttacacgccttgatttgccgtaggatttcatctgctcaatcaccagctccgtctttttccgggctgcagacagccttctgtctgtgcctgttcataatcattctaaggcatttgcctgcctttttcaagcacttaaagaaaattctgctgataaatcggtcatacagaatcatgcctgcaaatacccctcctatgacataggccctgaatacgccgtcattctgctcatagaggagaatgaaggtcacaagcccggcatagagccaatacaaaaaatcttccaccccggtccagaaggggccgtgccggataaccaggcggaacaccctgagggtgtcataggccagcatgagccaaccgccagtgaccaggctgagcaccatcagccaggcctcatactgaatcctgctgctcataatgcctcccctacttaaacaggcgggtgaacagggattccccggactttctgagggcttcgttggaactgtagaccatgctgtctatggttccctctatgtccacctctcccttttccagggtaaggcggcttacgtgaagctcctttcccttgatggtcagcagccccatatccgtgtccaggacaactgcattttcatcaaaggaaaccacatcgcatatgcctgtgatgtttcccttgcctctgttctgtaatataagcttatgctgacgattgcttccaatcttttcttccatgcaaaaaacctccccgtatatctaacctatgttaaatatatggggaggttggccattctatgccacttatcttaaatattgtaactgctaaatcatccgatgtaactgttactaaatataacggtaaagttccttggcctcatccttcttcacagtttcctgtacgtccagaacctccaccttaacggccttggctccgaactgaatctcgatgatatcacctgtcttcacactgacagacgcctttgccggcttatcattcaccagcacacggcctgcgtcgcatgcctcattggcaacggtcctgcgcttgataaggcgggaaactttcagaaacttgtccaatctcatggattatttattaacctcatcctttaatgccttgccagctttgaacttcggagtcttggaagcctcgatggtcatcgtcttaccagtcttgggatttcttccctctcttgcagctctctcagatacttcaaaggttccgaagcccactaactgtacttttccgcctttaaccagctcttcagatacagcgtcagtgaaagccttaactgccttctctgcgtccttcttggaaagctctgccttctcagcaactgctgcaatcaattctgtcttgttcatcaatttttcctcctagatattgtccgggaaaggccccggaatcgttactttttaaagtcatagtgtacttaatcatttatatctgttttactatgatttgtcaaggttttttggctttttcctgcatttttatctgattccagagggcggtcccttcctccacggaattcacctttacatcgccaaatacgtgggggtgtcttcggaccattttccggcataaaccgtcgattacatcgtcaatggtgaacctgccctcctcctctgcaatccggctgttcaggataacctggagcagcacgtcccccagttcctcgcacaggttttccatgtcctggttgtctatggcctggaatacttcctctgtctcgtcagccaggcatttcttcaggctctcaaaggtctgtgccctgtcccagggacagccctcaggcgaccgcagctttgctattattcccacaagctcatcaaatgtatacataaaaacctcctataccttctccttattgcgcttgattaccttgaggcgggtaaattcctccctctccttttcctccagcgcattggaaatggacttgctcaggtcctcataatgaggaatggtgatgttcttaagggcattggcccgtttctgggtctttttgatggagttggccagccggtaggcggagttctccaccatggaaagctttatggtcagctcctttaccttctcaaaatggtatctggcctcgtccagggactccgtggtgttgtagaaaccataggtcagggccaggggacgggcttcatgctggaccagggggatctcggttcccataatgcttctggccttgattttcacccggtcgtccaccggcacggatacgcctatctcctggacataattgatgcccagctcaatattggccttctggagggccgcataggcttcccggaaggtactgtcgatttcggactggattccctttgcctcgtcaatcagctccatcagctcccgaatcaggatgttcctctttttatccataagcccgtagcccatataggccaggcccagtgaattctttgccgctatgaggttgcctttggtgggaaatgtatttggatccatttacatcactccttcatggtgtccgcaggtttataatactggtcaagcaccttggtgtcgatacggtccagttcctccctgggcagcattcccagaagcttccagccaatatccagggtgtccaggatggttcggttctcatggggggcctggcctatgaaatgctcctcaaaagccttgccgaactccaggtatttcttgtcaatgggtgaaagttcatcttcgccgataaccgatgccagggccctggcgtcccccaccttggcatagcaggagaaaagctggttggccacgtcctggtggtcggccctggtatagccctcgccgattccgtccttcataagcctggacagggacggcagcacattgatgggcggatagatgttctgtccgtttagctgccggtccagaacaatctggccctcggtgatatatcccgtcaggtcagggatgggatgggtgatatcgtcgttgggcatggtgagaatgggaatctgggtcacggagccaggtcttccggccacaatgccggctctctcatagagggaggccaggtcgctgtagagatagcccgggaaaccctttctggacggaatctcgcccttggatgaggaaacctcacgcatggcctctgcgtaggaagtcatgtccgtcaatataaccagtatgtgcatacccttctcaaaagccaggtactcggccagggtcagcgcgattttaggggtgatgagacgttccaccacagggtcattggccaggttgataaacatggccacatgctcggacacaccgctctcctcaaaggtgcggcggaagaaatcagccacatcgtatttcacgcccatggcgccgaacacaatggcaaattcctcatctgaattctctcccagggacgcctgctgcacaatctgggcagccagctggtcatggggaagaccgtttcctgaaaagatgggaagcttctgaccgcgaatcagggtggtaagcccgtcaatggcggagattcccgtacggatatagtttcttgggtattcgcgtgtcaccggattaaggggcttgccgttgatatccagctttacatcggatatgatatcccccaggccgtcaatgggctggccgataccgttaaaggtacgacccaacatctcttcggaaacttctatctccatgggatggcccgtaagccttgtatgggtgttgcgcagggccatgccgtccgtgccctcaaacacctggatgatggccttatccccgtatatctcaataattcggcctatcttgtggagattcccggccacggtcatctccacgatttcatcataagccgcattctgaacgccctccaggaccaccagagggccattgatttcacttaaacctaaatattcaattgccatatggacctcccttatgcgtttcgttccacaaccctgtcatagaaatcatcaatcatcttcatgtaatcatcgaacatttccagatggtcattgggcacatcgtatttgatggatatgattttgtcgaatatgttctcctccttcagcacggacacaggcatgcccatggaaacaagggagcgggattttttatacaggtaaagaatgacttccatcatcttaaactgcttggttaaaggcacggatgtatcatccttatggaatgcattctgctgcaggaatcccaggcggatgacctttgcgatttcaagcaccagcttctggtcgtccggcagtacgtcggcgccaatcagctttacaatttccatcaggctgctctcctgcaccagcagcgccatcaggcggttccggtcgtccacaaaccgcttatccacattgtccatgtaccaggacgacaggtcgtttatatactccgaatagctggtaagccagtggatggccgggaaatgtctggcgtaagccagggatttatccagtccccagaagcagcgcacaaaacgcttggtgttcatagttacgggctcggagaaatcgcctccctggggggacacggcgccgatgatggtcacggagccctcggtcccattgagattctgcatcattcctgccctctcatagaaagcggacagacgggacgccaggtaagccgggaacccttcctctgcaggcatttcctccagacggcctgacaactccctgagggcctccgcccatctggaagtggaatcggccataatggccacatggtagcccatatccctgtaatattccgccagggtaaggccggaatacaggctggcttcacgggcagccaccggcatgttggacgtgttggcaatcagggtggtcctgtccatcaggggattccctgtcttagggtcaatcagctctgagaattcttccaggacctgggtcatctcgttgccccgctcgccgcagccgatgtagataataacatctgcatccgaccacttggccacctgatgctgggtcatggtcttgcctgttccgaaaccgccgggaatggcagccgtaccgccctttgcaagcggaaacatggtatccaggatacgctgtcctgtaatcagcggctttacggcgggaaaacggcgggcagacggtctggccacgcggatgggccatttctgggtcatggtcagggacctctcggtgccgtccaggagctgaagggtcagaaggggctcctcgattgtatactggccgtccggcaccactgtaagaacatagccttccacgtccggcggcgccataaccttatgggtgatggcccttgtctccggcacctccgcaatgatggtgccgggcatgattctgtccccttccttcaccaccatgtgggtatcccactttttatccgtatccagactgctcacggatatgccgcggctgatatagtatccgcttcccttggcgatttcgcttaagggacgctcaattccgtcaaatatattgctcaggattcccggcgccagcgtaacggacacaggggctcctgtgcctgttacaatttcgcccggcttaatgccgctggtctcctcataaacctggatggtggtcttttctgaagtaagtccgatgacctcgcccaccagcttctcccggcccacatgcaccatctcattcatctggaaccctgagtcgcccagcagggaaacgacaggaccatttataccgtaaatcacacctgtcttagccactttgcctacctcctgtcaagtcaaatttaaactcatggcgggcctcgtttaacttagtctggaatgagttgtctataagtatatgcttgcccggaagcacagccctggtgcctccgttaaaggaatattcgctgaccttgatggtggcgttgtgatgcatggcaatgcgctgcagcttatccgcgtccgaagggtccatataaataaccagttcctcgtcccccgcaaattccttggcagcctttacctggcggtccagaagccgctggtaatcctgtgtctccatgaagttggccagtttatcccttagttccacgaacagcttatccttaagctcctcctgcttgtggctggcttccctctttaaatccagctggccgatggacagccgtttattgatttcacgtcccagcttctctgtctctgcctccacctgcatgtcggcccgccttctggcgtcagccgcatgttcctcaaaggcagtctccagggcgttcatatagtcatccagcatcctggcgctgcgctctctggcatccgtcatacagatatcctggaaatgctttagcttttcctctgttgtcaagctgattcaccctctttctatcattactacagtttcagtccgattgcctcgttcacataagaggtgataaagtccggcttgcggccggttccatggcggtccggaatctccacaataagcggaagcttgcgctccagctttacattgtcgatgatttccggaaattccctgccgaatttctctgtcagcaggatgattccaatggatttgtcggccagggccttatccagttcttccttcagttcttccctcttatggaccacagccccctcgacccctgccagacgcatgccggtccaggtgtcgatgttgtcgctgataaggtacatcttcataggattacagctttcctaaaatcataaaggatatgattaatccatagagacacacaccttcggcaagacctacgaagattaatgatttaccaaggatggagctgtcctcgctgatagctcccagtgctgcgctggctgctgcggaaacagcgatgccgccgcccaggcaggaaagtccggtagccagggctgccgacagataacccatgccggctgcggatgaaccggctgcctgggctcctgcctcggccgccactgcattgccggagaacataaccacggctgcaaataccatggtgccaaagaacaggaacacattggctgccagggccgtcttatagcgtccttttgttttctcccctgctgcaaaagctccaaaaggtactgcaatgcttaaaataagtgctgcgctcagtgtaattttaactaataaactcatatctcatatctcctttttgtattatatatgcttactgctctccggcagcctttccatacggttcaaatgccctgccgctgccgcggtagaaacggctgaacagctcataatattccagacgcagtacctggatgcccacaatcaggccctccataccgcatacaaacaggttgccgccaaccaccacggcccagtttgtatttcctcctgcctctgcccctgccagcatcaggaccacctgcatcatggctgcatggctcaccgcaaaagcgcccacacggacaaaggaaagggtgttggaaaaatagctcaaaagcacttcaaagagttcaaatatcccctgggtgataaacattcccaggccggtttccatgcgctgcgcctttttctccaccatggcagccagaggctccttaaagaatatcaccagaaggggaatcaggaacataattaccagaatcacggtggcgggaaggggattgccggtcatatacagtacaatcacagctgccagggcaaagtaaaataccagcccggccacgccgttggtgtcaaaatacgccttctccacatcatgggaacgcaggctgttgatgatattgagaatcatgcacagaagaatgattcccattccaatggcaaccgccaccacaaatacggtgttcagccttccgataaagggcaggtttgtcatggcttcctggggcctgagccacactgcatccataatatcctcaaatccgaagatgcttccgaagagcagtccgaatatggtggagaacacgccgcagcaggaaatgattccggccagacgtattttcctgaaccggtacagcaggaaacctcccaccagcaggcacagcccctgcccggcatccccgaacatgaatccaaacagtatggaatacgtgattccaatcagtatggtggggtccagctcattataggatggcagcccgtacatctccacatacatctcaaagggtctgaacagtcccggattcttcatctttgtgggaggcgtgctcataatattgttgtggtcgtcctcaatgatgcagaaggtatcgctgtcccgttcgatttctttctggaactcctttgcatccttctccgtcatccatccgcagagaatgtagaagttatgggtgtcatgcttggtgacggcagccatcttcctcacgtcaaagttagtggaaaatacccggatgcgcctgcaggcagcggcaaactcctccttcctgctgctcatggcctccacgatttcccggtccgcctggtctatctccttctgaaggcttcctatacggtcgtccagcacatgtccggcctccacaggggtaccctcatactcgtccggcagaaaacaccgttcaaaatgcatggacgcatagatggcgtcaatcttatcggccagactctccggcacaaagtagaccacccacacataatccccctcctcctcgcatttaaacatgaccgtgtctatggtctcatacacataggatgagaatttttcataatattccttggaaatacgtccgaaccggaacttcatgaaccggaacttaagtatctccttcacattgtagttaagccctgcaaagggtaccaccctgtccctggactcctgcagctcgtcccgctggcgcaccagggtattcttccggtccgtcagctccttaagctgggcgtcaaggctgttaatgaccccgaccgcttcctccagcttcatctttcggtccgtctggtccggtatcagctcatgatagctttccagcaattccgaggccttttccagcacattcttatacggattcgtctcaatataaggcctcaggtcttttactgtcttaagctccgacagggcattttccaggtgtatctcgtatctggacagatatgtgtccaccacccggtcaatatcctccttagggccggtaatacttaagaacttcatcttctcaatcacgtcttaaccccctttagtcaacttgctcccagtccataacgtatcttctcaatggtagttatgatacgctcgatttccctctccttaaagtagagataggaattaagtatggcgatggagtatgggtcctttctgcttgtcttctggtaaatcctgtctattatatcgtgggacagctggtccaggtcctgattctcgtccagatggaccagccccgtcctgccgtaccagcttccctcaatcagcccgtacagtatatccaggctctccgcctccaccatccggctaatctctttcttagtcagatggagctgtatgggaatcagcatggcgtatatctctcccggctccagccggtaaaacttcttggaacggcaaatccactggagattcagcatatccatcctggtgccgaagcactgggcgattatcttctgctcattcttggacaggtacttgtcctttatcttccacatggtcctgaaatacagcatatccagcgctgtctcacaagccggaagggttaccctgccgttctgcagcatctggtacaagggcccgtaatacgcagatcccttcaggttccctatgaactcttccatgttttgggactgggaaagtgtgattaggtcaagggcagaatgccgctcaaagaaatcacggaacatggacaggtcctgccgctgttccctgtggcctgccgcattcctcagacaggtctttaagatggtaatttcataatgcatgaagtacaggtccaggaaacgcctctgctttatgttggcaaactggtaaagctttgcaaaatcccggtactgggacagattcagatgctgctcaatgtttcccctgtgcaggtccccgtcctccacctggtcgaatatctcccggtaaggaagaaaggagcgcaggtactgcactgcatccgctacggtttccagggccgccatttcaaggaactgctcatcttttatacgccagcgctccattgccttcaccttggtggcaatgccgctgtaagcaatcaggctgcccataatctcactcctttatcattttctggaacagagcctctacatattcttcatggtgccggttataattgtcttccagctccttaagcagagtctctgattccgccttctgctttgcaaggagcccgttcatgtccgcctccattttctcctgaatctctgcaatcctgcgggccgtctcctgttccaggttcttatcaaaggcagccgtctttgcatccatctccccggcaaatgctttcttgcgcacattcgcctcttccacaatggctccggccgctgcttcgatttccgataaccggttaatcacagtatccatagctctcctccttatatattttcatatcatttcatgatactacttttttagaaaaaaaccagaggtattttatatttaaatttaatttttcacaattttctcacagcaaaacgccaaaaagaggaagaactttttaaattcttcctctttttacatccaaaattgccaattttttctatacaattttcacaaatattcaggtctaattggcttccggagcctcactgctcccggtttcgccctcggctgacgccacaggctctaccttttcaatgtacctgctggacacatatgcctcctggccgtcgtaattaatgaccgcccagtcgttgtcatagcgcttcacatatactacctcggtgccgctgcccagctgtaccagaatacgcccgctggtggaaggctcgctgcggacattgacgctgctgcccttaatccggtaagtttccgccggcggctctgtctcaggctctgtctcaggctccggaggcggcgtgggcgccggttccacaggtgccgtagtcacggtaggtaccgtggtggtcttgtccgcatccttgtccttgccaggcatgaaaacacggataaccacaatcaggagaatgacgagaagcacaggaatcaacagtctcagtatgtatgctgccggcgatacgcgcctgcgcttcttcctgggacctccctgacgggacgggccgctgcgggtattcctggccggcacccgctggctgcttctgccggaagcacttctgcctccgccgccctgcctgggtgcctgacgtcctgacgtattccttgcagatgaggatggtctggccgtgcggccccctgaacctcctgcaaattcgttggcaaacacatacacttcctgggtcagcagctggaaggcctgattggcatcatatgccgtgtcatccccctcatgaaccgccttatttcccaggatacggatggtgtggtaattatccttggtagccttgttaatccattggccctcgtacagctggtctatggtgtcggacaaatccccctccaccacacaggccctctcagccatgcaccttaccatatattccaggacctgtctggccctgaccatcacaagattatattccttgcgcgcaatcaatcgctctgcttccttaacgccctgctgaatctgctgccagctggtcgtccgctccacattcgacataagccttcctccttagtatcgcagatatccgcctattatgtatagtatactagatttttgctaattttgcactattaattataaaaaatcagaaaaataagaaaaaagtaaattttgttgcaaatgcatcttttgaatgttaaaataaggcctgcagcaactacatcacgaaaggatgaaacacatgcgattacgccatatccagggcgccgaggaaaccattgcctccagcccatttgtcattcaggaaccggaacagcaccgcggcgcgtggaaccaggtattcggcaatagcagcccccttgaaatcgaggtaggaatgggcaagggccgtttcatcatggaaaaagcatccgccaatccggatatcaactatataggaattgaacgctattccagcgtcctgctgcggggacttcagaaacgcagtgaaatggaccttaaaaacatttacttcatgtgcatcgacgccaaggacatggcggaaatcttcgcgcccggcgaagtggaccggatttatctgaacttctcagacccatggccaaaggaccgtcatgccaagcgcaggctcacatcccctgtgttcatgtcggtatacgacaaaattctggctccccggggagtcgtggaatttaaaacagacaaccgcgggctctttgaatattccctggaatccattccctccgccgggtgggagattacagagcacacctttgaccttcatggcagccccatggcggaaggaaatgtaatgacagagtacgagatgaagtttgcctccgaaggcaagcccatctgcaagctcattgccaggcgtacaggcacccccggccggaaccctgcatagtatacaggtaaaggataccatcaggaggcggacaacatggcactccctccgggaatcaccaaaaagctccttcaggccaccagcgataagacagacttaaacaaacaggcgctccggttcaaccgttccttcaaggaagtcggcaaacttctgggccccggttcagccaaggctaaaaaggataagaaatagcctctgaaaagaggacacagccctccggccgcctgctcccataggaacagacggctgcggacggcggaaaatcccggacagaaaaattttttcccgaaaagtgttgacattttgctttttaggcgatataatggcgaacgtgctgttgagacagccgcacaacaaaataagaaaatgcgcctttagctcagttggtagagcagtagactcttaatctatttgtccagggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatgcgcctttagctcagttggtagagcagtagactcttaatctatttgtccagggttcgagtccctgaaggcgcactaaaaggtctgattttgcagatatcggaagctgcggggtcggacttttttgttgtccttccctcaatccagatggtattcctgtatcttccggtataacgtagccttgctgatacccagggcatccgctgccgcctgcttgccgtaaggaccgttaaagcgctgcagcgccttctgtatcagctgccgttcctgctccttcaggttaaagggtccgtcgttctgtttaaaatcaggaagcctgagcacatcttcttccccaatgatgccgctggtgttgatggatatgaggtagcttacgacctgttccatctgcttgaaattacccggccaggaataattcttaagcatggtaagggccctggagctgcaggcaacctttttcttctcaaagtcctgataataaatcagatacttctgaatatagtagtctatgtccatgtcccgctccctgatgggcgggatacacaggatggccggatagaacaggttgaagagacgtttggaaaatgcgttgtggtctgccagctttgccaggtcctccagggtggttgcaatgaggcggatgttgtggttttccagcagggtgatgttatctgccagctttagctggagccagtagggcagccttggtatctccttcaggcacacggtgatatccctgccgcagaatatgcctgtctcctcatcaaaaacctggttggcgaaattcaggtccgaaaatgcattgcagtcaaaaatcaccagctcctgctgggcatagcgcccgctgttatgtatggcctttacccacatttcctttcccagcccccgttccccctgtatgaccaggtaacggctgatttccgaaattttcatcacgtcctgcttcatcttggtcagtatctcactggttccctcaaaataatccagggacaggttcctgctggcatcctggaaatagctctgttccgtcacaagattctgttccagtacaacatactccagccgctttcccataaggaaatccgaatcaaaaatctgatgctttgcatgaaggcgtatggacctgttctccgccctcaggttcagccagtcgctgttctttccctttatgaccttgaccgtctcccggaacaggtcttccccgattcccattctctgcatctggagccgtgcgtttttgttgaccttggacacccggcggttttctatcaggacagcaccgtcctccatggtatccaccatatcggaaagcgcgtgttccgtcacatgcagggcatcctcaagcagatacgattccgctatcctggtaatgacctgccccacatggattgccagattcttataatattcagtatgttccagcatatccctgtgtaccttctcatcatagcacagcacggacagggtgcccagaaatgcctgtttgatgtataaaggcaccaccacctctgctctccccgtgcagatacggttggtgctgcatttgcgacagacagggctgttcctgtttctcacaaatataagcttcctgtccgccttggcctgttcaatggcgctgtagggctggttctcattggcatagatgatggaccggaagatgcctgtacccgccaccctcatggtattctcatcattcacatcatactccaggcaggtaaatcccgcataaaactcaatctctttctgaacaatggctgcgcaagcacttaatacagattgtttcatttctttcccccatttgtctcataatgagattatagtctcaaaataagacatatacaagaggttcccccatttttctctttttttcggctccccctcacttgaataatggctcatgtatgaatagaattacggtaacctaggtaaataaaatataagtgagggaatgttatgatttgcaaagaaataccaaagaccatgtactgccacattggtggctcaggaacctggggatgcgagtttcccgaagatttacatatggaaggcatcaccctgttaaaacgggatatggaatttgagactcccttcggagtcactgcctgcatgaagctgtatgaaatggatgcctccatcaccgcagaccataagacccgccaggtgctctatgtgccgttccacggatggaaagggctctccccttacgacgacactcccagcgagcgcattttctgggctttaagggaggccggggtaaaatacatactggcagacggcagcggcggcggtatcaatccccttctggaaccaggcgacatcatatgcccccaggatttcattgattatacaaagcgcgtgtcctaccttggaaaattcacgccctacagcatgcgcatgagggaaattatatgtcctgacctgcacaaaatactgcttgaaaaggcctcaggcgtattccgccgtgtgttccgcaccggtatctacggcgtagcggaagcccccaggtttgaatcagccgcagaaatccagaaaatgtatgcagaccactgcgatgtatgcggacagaccatgatgcccgaggcagcattggccagagccatcggcgcctgctatgccgccctgtacgtcatcagcaattcagccgagggaatcaaccccaactgggagcgctccatctttgacatttattccgaatgcgcccctgtggtcggaaaggttatgctggaggccatggctgccatcaaccctgaaaccatgaactgccactgcgatgagaacatcatagaaatgcccaaggccgtgcagaaacgcctggacatgtagtgcatacaaacagaggaggagaatatcatgaaacattttaagttgttgacagcattggcgctgacagctgccatgaccgtatccctgaccgcctgccagggcaaatcagcttcatcgcccgcagccgaaacccaggcagcctcagattccaaggcagaagattccaaggcagcggattccaatggtgcggattccgggaaagcagactccaaagccccggctgacggccaggcagcccaaagcagcacctcagagccctttaaggtggcgcttatgataggtatcggcggactgggagacggcggattcaacgacagcatgctggccggcgtggaagctgccaaggctgactacggaatcgaatatcagctggtggagcccaaagaaatatccgaatttgaggccaattttaccgacctctctgcgtcgggcaaatatgacctgattatcggcggcggctttgacgctgtggaggcccttcagaaggtggcctccgagttcccggagcagagatacctgtttgtggacggcgaggtaacaggatgcgacaacgtaaccagcgtactgttcaaggacaatgaaaaaacatacctggttggaaccgttgcgggacttaacaccaaaaccaacaaaataggcatggtggtgggcgtggacagcccctcccagaacatcttcgtggccggctacatggccggagccaaggctgccaatccggatgtggaagtgattgtcaaatacgtgggctcctttgccgacaccaccactgccaaggagctggcactggccgaggcggacgcaggcgcagatatcatctttgccgcagccggcggttccggcctgggcgtattcaatgcagctcagcagggaacctttaaggccattggcgcagatgtaaaccagtgcctcatcgacccggaccacatcatgctgtcagccatccgcaagattgacgtagtcatcaaggacggcatcaaatccgccatagacggtaccctggaaggcggcaccatggttcccggacttaaggaagacgccctgggcatcaccaatgagggctccaaggtggagattgacccggccagccttgacgctgcccagaccgcaaaggataaaatcatctccggggagattacagttccttcaaccatagacgaagttaaataaccggctgagaaaggtgctgcttaacacaagcaacacctttcctttcacacagggaggtcccaatgtatgcaatagagatgcagggtattaccaaaacctttcacggctcctatgccaataaggaggtatccctcaaggtagaacagggtgagatacattcccttttaggcgagaacggcgcaggcaaaaccaccttgatgaaaatcctgttcggcctttacaaagccgacaaagggcggattctcataaacggcagtccggcagccatccgttcgccccatgatgccatagattatggcatatccatggtccaccagcactttgtcctggtgggcaaccttaccatcacggagaacatcattctgggccatgaaccgcgcaggggcattttactggaccgcagcagggcccaccaaaaggtggatgccctgatacgccagtatcactttaacctgaatcctgaaagcaggattgagaacctgtctgtgggagaaaaacagcgggtggagattcttaaggccctttataatgaatcctccatcatccttttggatgaacccaccgccgtccttaccccccaggaggtacaggagctctttgccatgctgaagcagctgaaggaggacgggaagaccattatcatcattacacataagcttaaggagacactggccatcgcggacaacatcaccatactccgccgcggagagaacattgcctccctgcccgcagcccaggccaccgaggacaagctggccgagctcatggtgggccgtcccatatcctttgatgtacagcgggttccctacgatggttccggccccgtcaagctgagccttcagaacatctgcctcaaaaagaaaggcagggccgtcctcactgacatcagcctggaatgcagggccggtgagatactgggcattgccggcgtggagggaaacggacagaccgagctcatagaggtggtcacgggaattgagaatcattttacaggccgggtctgctgcggctcccagccggtttctgcaatctcgccgcgaaagatgctggactatatcggccatattccggaggaacgcggaaaacgcggctttgtaagaggattttccaattgggaaaacatcatcctgggataccattaccggcctgaatacgtgaaacacggtttcctgaacatcagccgcatcaaacaggttgccagggacactgttgaacagtttgatgtcaggaccgacggaatcgaccagcttaccagttccctctcaggaggcaaccagcagaaactgattataggccgcaccctgctgcaccagtccaacatcattgtggctgcccagcccaccagaggcgtggacattggcgccatcgaatacatccatcagcacctaatgcagatgagggactccggctccgccatcctgctgatttccgccgacctggatgaggtcataaagctggccgaccggattgcggtgctgtacgaaggcagaatcgcggcggaaaaggagactgcagcttttaccaaaacagaactgggctattatatgctgggaggcaattccaaaagggaggtagctgacaatgattaaatatctgaagagccgtacaattgcatttaccctgatttccttccttatctccctggtattggcaggcatcatcattgcagccgcagggtattcgcctgtggaagcttactccgccatgctgggaggcgcctttggcagcacctataatctggcccagactgcaggcacagccattccccttatatttgcaggactggccatggcagtggcgtccaaggccggtatctttaacattggtatagaggggcagattctggcaggcgccctgcccgctgccctggcaggcgcctatatcagagggctgcccgccgtcctgcatatacctgtatgtatcctggctgcagctgttttcggcggcatatgggccatgctggctgccgtgataaagaataagctgcagataagcgaagtcattatcaccatcatgcttaattatgtggcgctgtacctggtggaatatctggtgaacaatccctttaaatcagagggcatggtggtaaggacagaagagatacaggacagcgcaaggctggtatccctggtggcccatacaaggctgaacacaggcatcttcattgcccttcttgccgttttcctgttctgggtccttttctacaagacaaagctgggatatgaaatgcgggcaaccggagacagcccctttgcggctgaatcagcgggcattaacaataagaagaacctgctgacagccatgttcctttccggcgccctggcaggaataggcggcgcctgtgaagttatgggggtacagggctattacatatccggcatgaccacgggatatggcttcagcggcattgccattgcggtcatgggacacaatgaaccgctgggaaccctggcctcggccctgctgttcggagcccttaacgcaggggcttccagcatgaaccgtatgacggatattcccggggaattcatttccgttctccaggcccttatcatactgtttatctccacgccgggaatcgtaattgcaattcaaaatctttacaaaagaaggaaggcggtgacatcatgagcggtcagattctctccctgttagccggcatggtccgggtggccataccgatatcctttgcagccctggccggtatgctgtcagaacgggcaggcgtcatcaatatgggactggaaggcattatgctcatcggaagcttcttcggggtggtagggtcctatgtgacaggcagcgcctggatgggcctgctcttcgcctgcctctccggtatcttcatgggcctggttctggtgaccctgaccgttggctttaaatgcgagcatgttctggcaggcgtgggcatcaatatctttgcctcaggcattaccattgtgctgctggaaatgatatggggcaccaagggcaagtccagcatggtggcgggactgggcgtgctgaaggtgcctgtggtttccaggattccggttatcggggatatcatcgggaccatctctcccctgttctacatcctggtcctctgcgtcatccttctctggttcctcctgtacaggacgccggccggccttagaatcctggtcatcggcgagaaccccgagatggcgggcaccatgggggttaatgtctataaaatgcagtacctctgcgtcatggccagcggcatgcttgccgccataggcggagcctacctgtccatcggggatatcaacatgttcagcaaggacatggtttccggaaggggatacatcgccctgtccatggtcatccttgggaactggaaaccgctgtgggtggccctgggaggtctggtgtacggatttgcccaaagcctccagttcaggctccagggcgtcaacattccgcctcagctggtacagatgctgccctatatcctgacccttgtggtgctgctgtttgccagaaagaaaagctctgcgccggctgcatcgggcaaacattattatcaaaaaggagaatagctgtgggtaaaattcagatagatacagaacacgccagagaacttgcggatgattattcctatgtgatgcgttcctttgcggatgcgtacgcggcccagaaaaagggagtgaaaatccgcccccggctgggcgaccggatgccctttaattatatgagggaacgccagaccctcaccttcctgttctaccccgaactgaaggaggctgcctatgaaatttcccgcatcataggcgagagcatcacctcagaccaaatcaagggaaagaccctgccggaaatcatggagagcaaccagcccattgcccagagggacggatacgcctttgaggaagtggtggaagccgatgaaacccacgcagtctacaggcactatgaatgtgcggactgctacgggcttcccaacatacattccaaaatatgcgtctacgaggccggtacggctgcgggcatgttctcttccgccctgggaaaaccctgccgggtgacggagacaaaatgctgcgccaacggcgacccttactgcgaattcctggttgaggtaatggagtaatgggagcagcagaagtaacgggggccgggcggcctttgcggcggacagcccccggccgctgccaccgcccctttctgctcccaatcaactgccggtaaacaatattgaacttttttcgaaaaaattattgacttttttcttaatacgcattataatagtggacgtgtcacttaaagaaacaaatgaatcgcatgcgcctttagctcagttggtagagcagtagactcttaatctatttgtccagggttcgagtccctgaaggcgcactaaaaggtctgactttgcagatacggaaagctgcggggtcgggcttttctttgttatataaaacacatgccataccatcatacaggaggaattatgaaatatttacaccgaaccgccggaatcataaccgcattttgcctgatgattatccttttcatcacttccgtggaagcagtggtatactggacgcccggttattttgaaaaggagtacacaaaatacaatgtgctggacagcctgccgtccatgaccatggacgaccttctccatgtaacggatgagatgatggattatctcaggggcgacagggatgacctgcacgtaaccacctccatgggaggcgaacagagggaattcttcaaccaacgggagatagcccacatggaggatgtacaggtcctcttcctgaaagcgctgtccatccgcagggtatgtctggtcctcgcagccgggctccttattctcatggccgccaccaaagccaggatgggacgggtccttccgccttccctgtgtatggggacagggctgttctttgcactgattacagcccttggccttatcatatccacggacttcaccaaatacttcatcatgttccaccacatctttttcaccaatgacctgtggattctggaccctgccacggacatgctcatcaacattgtgccggaaggcttcttcatggacacggctgcccgcattgccctgctctttggctccctgtccctggttctgttcggggtctgcctgttcctcaccgtgaaaaaccgcaggaaagaaggctgattggacacagattcagaaataacgcccctctccagcctttacttgaagccgtaaatcctttatactgtatcttagcaatgaagtgaatggagaatatttggatgaagcgattccttgtgttgtttatatgcatctgcctgtccgcagggctccttcccatgacagcaatggcagccccagaatggccctctgatgtgtccatccaggccgatgggggcattgtcatggactcggacaccggaacagtgctttatggaaagaacatggaccagccctattacccagccagtatcactaagatactgacagccctgattgtgctggaacgatgcgacctgaacgaaatggtcaccttttcccatgatgatgtctacaatgtggaggccggaagcagcagcgccggcattgatgagggggatgtcctgacggtgcgggactgtctctacgccctaatgctggcctctgccaatgagagcgccaacgccctggcctgccatataagcggctccagagaggcatttgcccagctgatgaacgagaaagcccgtagtcttggctgtacgggaagccatttcaacaaccccagcggccttaacgacgagaaccactacaccacggcccacgacatggccctgattgcccgggcagccatccagaacccggaatttctcaccatcaacggcacccggagctatcagcttgctcccaccaagcgaaccccggaaggaggctatgtggccaaccaccacaagatgctgaataagaacgaggccgtgtattatcccggcgcgtttgcaggcaagacaggctatacctccctggcaggcaataccctggtcacctgcgccaggaaaaatgatatgacgctgattgcagtggtgctcaacggccaccagtcccattattccgataccaaggccctttttgactttggattccgcaatttccagtccctgcggacggttgactacgaaaccaggtacaaatccctggaaaatgacatgaccattgccggtatgacctcaggagacagcatatccctggagctggaccgaggcggccgggtggtgattcccagggacgccgactttaccgacacccagtccaccctgacctatgatttggacggcagccgtccgcagacagccgttgcctgtatccgctatacctacaatgacaggccggtgggctccgtgtacctatgttccccaggcctggagggaagcacggtctccctggcatcccaggatgcccccggcggttcagcaggaaacgccggcagcccctctgccgcctccatggaccagaccctggcaggggctccccacggccagtccgcagtgccccaggaccagtcaccaacgccccaggaccagtccccggcacagggaaaccaggctccggcatcggaggaccagcacccggcgcagggaaaccagcccacagtttcaggcgcctccccccgccaggacattacctccaaggaaggcaccgccgccagcatccggattccggccaacaccctggccatcctgggtattgcattttccctggctgttatcattgccattgtggcagctgtgaaaatccacgtgcgaaagaaggaggaggaggatttatacctgagacggcagcggaggctggaacgtctggaagatatcggtttttcgtccactgactttgagaagctggttgcccagcgccgtgtctccgccccatccctgggggaaaaaggaaaaaaaagcaggggacgcaggcgtaaaagattctttttccgttgaacttccccccggcataggctataatgaaaattgttaattcattcatgcagccggaatacggccaatgccaacaggggaatatgtaatgaaatcatttcatttaaataaaaccgaccttaaggctgctgccatgaatctggtaaggaatctgcccattaccattgaatatatggctgcagccactttagtctccaccatattttttcacttcagcaacaatgtgacaaatatatccattatatacaccctggccatcatcatgattgcccgtgctaccagctgctacggcgccggtatcctggcctctctctttggcgtgttctgggtgaattttgcctttacttacccttacctgacattgaatttcactatgtccggttatcccatcacatttctgggcatggccctcatatccagcctgtccagcagcatctgtatcatgattaccaagcagaatgtccagctccaggaaaaagaccgcatgctgctcaatgcggagaaggaaaccatgagggctaacctgatgcgggctatgtcccacgacctgcgcactcccctgaccagtatcatcggctccagctccacctatctggaccaggaggatttcatgtcccctgaggaaaaacggaagctggtcaggaacatagaagaagatgcccagtggcttctcaacatggtggagaatctgctttcagtcaccagaatccaggacgaaaaaggcgtggcctcagtggccaagttagacgaatccctggaagaagttatttcagaatccgtccagcggttcagaaaacggtttccggatgtccaggtgcgggtcagtattcccgactcggtcatcataatccctatggacgcaaccctgatagaacaggtaatcaataatcttctggaaaacgccctgttccattccggcaccaatggtcccatcgacctggcggttaccacggaacagcgggtgctctccgtatccatcaaagactacggaaaagggattgccccccaactgctggataccatatttgacggcggaggcgtatcggaaaaccacacaggagacggacacaagggaatgggtatcggcctgagcatctgcaaaaccattatcaatgcccacggaggcgagatacacgccggcaatcacctgcggggcgcccagtttacatttaccttaccagattggagggaatactaaatcatgaacaccaaagccaacatcatcatcattgaagacgagaagaacatctgcaatttcatagaaaccgtcctgtccccccagggctatcaggtcaccagcgcctgcaccggaacagacggacttaagctcattgaatccctgaagcccgatgtggtacttctggacttgggactgccggatatggacggtctggaactcatccaggaggtcaggtccaccagcaccctgcctatcatcgtgatttccgccaggaccctggagcgcagcaaggtggctgccctggacctgggagcagatgattaccttacaaaaccctttggaacagctgaacttctggcacgtatccgcacagcgctgcgccacagccagagagctgccggcacccagagccttaaatatgaggtaggggaccttctcattgactttgaacgccgcctggtaaaggtaaaggggcaggatgtccatctgacgcagattgaatataagctggtttccctgctggcccagaacgccggtaaggtcatgacctacgagagcattatttccaaaatatggggaccgtttgcagacagcgacaaccagattctgcgggtaaacatggcccatatcagaaggaaactggaggaaaatccggctgagccccaatacatattcacggaaataggagtgggctaccggatgcgcgaggaatagaacgaaaccgatgaatcaaaacaggactgctcaagacagagcggtcctgttttcagttcctgaattcattcctgcgcgtatccccggatgttaccgttcagcctcatcctggttttatagaaaataccgccccagtccttccagaaaatactgtccggccacagcgccctggtccggaacgcccctggcttttgctgagaaaacagcggcctttccatacttgggaagcatatcctccgtggctctgacgccttcctttgcaccctccactgcccggcggagcatggctcccatatctgcgccctcagccaaggcctgctgcgccatctttgccccggcatccactgcatccaggatggtccggtcccccagacggcacttcccgcggtgtgcaatccccacggcaaaaccagcgagaaaatcagccagttcctcaggccccatctcccccttttttgcaagggccttaccgccctccatgattccgctggacatcagggttcccatggtagacggaaccagaccagccatcttcatgcccgccttcatgagtgtctttcctatatccccttccacctcattctcacgcatcagccggggcagagccccaaagcctttctgcatggtcaggcccaggtccccgtcccccattctggcatccatctggcagagctcttcctttttctccgcaaagatatccgcagcaccctgaaaaagggcaggaagttcacgacatgtaatccgatccattttttcctccttaaccagccatgtggctaattcctgttaaacctgggtataaaacggcgtatggacaggcatatccatccactgcttcatctcctggtccgccatacggcagatggatatggaagcgccggccatctccatactggtggcatattcgcccacgaaggtacggtaaaccttgattcccttttctcccagaatgcggtgcacgcttccggacagaatataaagctcctcctggctggttgctcccagaccgttaatcagcacgcagacctcctcgcccggattgagaggcatatctcccagaatctcccccaaggattcctccgccagttcatccgctgtcttaaccggaccattccacacgccgggttccccgtggattcccattccaaaggccatctcgtcctctgccagggtgaagttggaatgaccgatttccggtatgacgcagggcgtcagggcaaagcccacggtcctggtattgtcctttgcctttgccgccgcggccagcacttcctccagcgttccccttccggcagccatggccccggcgcatttatacatgaaaaagattccggccacgccgcggcgcaccgaagcatcctgactggacagcacatcgtccgcgcccacgatactggctgttttgatatcatccatgtccagcatctccgccgccatatcaaagttcatgatgtccccggtgtaattcccatagaggaacaggactccggcgccagcctccacctccctggccacattgtaaatctgctcagaagagggggactggaacacgccgcctacgccgcatccatccagcaggttctcacctacatatccgaggaacaggggcagatgccctgtgcctcctccggtgatgatggccaccttgcccggtttcttctttgccgtgcagtagcagcggaggtcattctccgcatattttaccatatctccgtgggctgcgtagattccccgcagcatgtcatctgtataagcttccggggtatttattattttcttcatctatgtcctcctaaatccttctaaagaatgatttcttttggataagcccacttctgcagttcctcttcaggaagggcatggggttccgttccctttcccgcagccagggtgatataatacatctccgcaatttcctccacatactgggccttcagaaacgccgcatccatgtccttatccgccgcaatggcgccgtggctctccatcaggcagcactcatactccttcattacctctgccaccttctcagccaggtcaacggtgccggctcttccataaggcgccacgggcacggttcccgtcttacccaggtaggcgcactcatatacaatggaaggaatgggtttgttcataatggaaaatgcagttgaatagcgggcatgggtatgcacaatggcccggatatccttccgctccttataaatgtacaggtgcatcatggcctcactggatggtttgacctcctgtgccctctctatcacctttccatccaggtccatgacacagacgtgctccgttcccagcacgtccctcgccacaccgctgggcgtgattaccacatacccggtttccgggtcatatatgctgaaattccctgatttgtgtttgcacatgccaaggcgttccgcctcctttgcagccgcaaccacctgctcctttaatgtctctagcatgtaaaatccctccgcgccgcccttacaggcagcctttctgtatcatgatgcaggcgtaaaatgccgtttccgtggtggataccaccgcataagcctcctttgccgcgtcatagaacgcgaaccggtccaaaaagcccactgcgtccgcaccacgttggtcatgttttgccacaatatccgtaaactcgtcccagaccgggcactccaggtcacggtgcatatccattttatccatgattgtaacaggcttctccacaaagccgtccaggggcatcagctccagtatggcatccagcatgtcggtggcccggtgcccgtcacaccggatgttaatatgattcttctctgctgcaatggatgcagccggaaaattcgcatccccgataaccagagtgtctccgtgtcccatctcatgcaggacctttaacagctcaggcgaaatgcttgcaggtattccactcagcatatgcttacctccctattcccaatgactcaaatgccttgtcatagggcgcatggcacatccccttttctgtgataatgcccgtaatcagggaatggtccgtcacgtcaaaggccggattgtacacattgattccttccggagccatgcgctccctgtaccacatctccgtcacctcgtcagggcttcgcatctcaatgggaatctgctctccggtcagtgtatccatatcaatggtggaggtaggcgcgcacacatagaaggggattccatagtgctttgccagaatagccacgccgctggtccctatcttgttggcagcatcgccgtttctggccacccggtcgcagcccacaaagatgatgtcaattttccctgacttcatgagtatggaagccatgttgtcgcactgaagggtggtggtgatccccgcattatacagctcaaaagaggtaaggcgggcgccctggagaagaggccttgtctcatcgcagtaaacatgcatgtcggttcccggccatcccttttccaacgcaatatacatgggcgctgttgctgttccgtatttggcggtggccagggttcctgcattacagtgggtcaggatgcctatttccgctccctccttcttaagttccttcagcagtccaaagccaatctcaccgattccgcggctaatcccaacatcctcctcccgaatcttatccgcctcctcaaagagaagctccttgattgcagccacttctttatccttgttggcaacagcagcggcctccatacggttcagtgcccagaacagattgaccgccgttggcctggacgaggccagataatcctttaattccttaaacttcccataaaatgcatcataccggtcctcatcaatgccagctgccagcagggctatgccataggcagcagccgcgccgattgccggagccccgcggaccctcagcttcttgattgcctcccagatttcctcctttgtattcagactgatacgcttaatggtaccaggcagaagcgtctggtctatgatgtccagagagcttctgtcctccctcatcctgaccgtaatcacctcgtcaaaaaattcctcaaccgtcatggtttttatgcctccttctctcctaaacctgtgtaacccccatcttccggctgaccctgtgcctcagccttccagggtcctttccgctgtttcctttgcccttaatacagctgccacataatcggctccggccttaaaggctccctggttcatgatatattccttgcctgccagtatattgattcgctctgcaaggaggcgttttttctcatcccggatggtagtcacatccactacattggccatgccaacggttctccggtgcagctccgtgcccgcataaccggcagtatccctcaggatgccgtcaaaataccactccttaaagccctttacctttgccattggctctgtcaccgcctcgtcatatttcctgccgaacttctcaataaagaggtccactgtctcctctatggtcctaaggcaccagtcgcagaaggctgcatcatccgtggaaaggccgttgtcatatgcaaatatcaggtttgccaccacatttcccacatcatagcccatgggagcgtaggttccgaattcacagtcaaatatcttggtggaatcctggcggataaagatggagccggtgtggaggtcgccgtgcagaagcgcctgggcatctgtcataaagcggaacttaagcttgctcacctccaggtggagcgcctcatccccgtagagctccttcttcacgaaatccgcattgggcccatacacattgttacggtcatataagtccatatagggctccatgagcaccagcttttccgtgatatcacagaggtcaggcgaaataaacttttttaccagctcctttttctccttgtggtccatgaccacgtcgctgctcaaaagaagggtgttcaccataaaggtggagacatcctcagcaaacccaggaaatgtttcatgcttcagcatggcatcccgcataaccgcataatcagagcagtcttccatgccgcaggcgcacatgaccgtgtcaaagaaatacacatgaggaaccattcccggcgcatactggtcctccagcatgagaatttcggattccaggcggtttctgtccctggatggctttatgtccttggatatcctggcctcggacccggcctgtttaatatagatggaatgccccttgccgtcccacacgcggtacacataattcaggttgccatgggaagggggaaccactgcttccatggaatcacggtcccagggaatctccgcagccttttccagcgtatactcaataacatcccccacgttcatctgaaaatattgattgaatcttgacatatgtagtaacctcccacttaatcttctttcttagacgcataagccgcaataagcgccagcgccagtacagcaccctttactgcaggcagaacatagaacggaaccgcacagatggtaaggccgttctccagtgtggagaccagcattgcgcctatcatggtacccaatgcattgggcttctccgctccgcccacggtccgtcccacgaaaacagctgccagagacggcatcaaataattatcacagcacataacctgcgcagagcttcccctggatgccaccaggataccgccgatggcgatgaacacagcggtaatcatacctgccagatagcggtatttctttacatcaataccggacagctttgcagcctccttattgccgcccatggcatagagataccggccatgcttggtaaagttaaggaagagataggccacaagcacacagcccagcataatgatgataatccacggggcgcgtccgatggctgaaaatgactccgaaagcgcggtgcgtgcaggcgccgccccccaggaagtcttcatgccggtggagactgcgcctccgcctatgtaccactggccgattccctgatggacaaacatcagggcgcaggtagcaagcatatccggaatcttgcagacaagaatcaggaacatggtcagctgatacatgaccagggtggccagaatacagattataatcgacatccccagggactgtcccagccagagatatgcagacacaaacacataagcagagcagctggccaatgttccggcggacatgtcaaaaccgtccggcgccatggtaatagtggccgctatgccgaataccgtattaatggccattgccctgagaatattcaccatgttgctggtcgacataaaagagccgcccttataggctgtaaatgcaataaagcaaacaagcagcgccaggaccgcagcccaatccactaaaaatcttttaatatttgtacgacttttcatcgctaccctattcctcctgtctattatttcccgttctgattgtctttcccgccaactgagtagtacataatttcgtcctccgtggtcttagcggtttccagctctgccatgactgtcccattgtacataacatacatccggtccgtcaaagacagcagctccgagttttcacaggaagcatagataacgccatttccctgttttgcaatttcattgattaaatggaaaatgtcctgttttgcccccacatccactccctttgtgggctcgtcaaatatgtatacatcgcagtcagccgcaagccattttcccaccgccaccttctgctggttgccgccggaaaggttcttgacctgctgccgcacgcttggcgtggcaatcccaaggtcctttacgaactgtttggcgttttcctccaccttacgcctgcggataaaaggccctgtgcagaacctggagagacatgccgccgataagttaaagctcacgttctcatttaccagaaccccctccttacgccgttcctccggcaccagggccatccggttctttactgctcctgagggatttgttatctttaactccttgtccttcaggataacccgcccgtccgtctttttatatgccccgaaaatggtcttgcaaagttcggattttccggcacccaccaggccggcaattcctaccacctcgcccttcttcacctggatggacacatcctttacctttccgcctgcgccggataaacgttctgtccgaaacagcacctctccaatccggcaggcttcctttggaaagttctcctcgaacttgcgccccagcatcttctccacaatctcttttgtggtagtattgcctgttaccggcgtggtgtcaatgagtttaccgttgcgcattaccgtataattctcgcagacctccaggatttcatttaaccggtgggaaataaaaagaattgcgatattttcggtttcatgcaaatgcttgacaatccggaacagttcctctgtctcggtattgcttaaaggagcagtcggctcgtcaagaatcaggaaattacattccgaccggatggccttggcaatgagcaccatctgcttctgggccaaagacaggttctgcaccagttcatgctcatccacctgttcacggctgatatgcagccggtccagggcttccctcccctgcttatatgcttttttccaatttacgatatagccgctctttcccataaccatatcgttctgtacaatgttctccgcaaccgataaggtggggtataatgccatatccacttcctgatacacaatctggattcccagcttcttggcatccaccggcgtcctgacctccaccttttttccattcagcaaaacttctcctgtataagtggaattcgcccctgccagcaccttcatcaaagtggatttccctgcgccgttggcacctacaactgcccggatttcaccggttgaaacctcaaaattaatgtcgtcaagtgctttcacgcccggaaattcaatggaaacatgttttgtttctaatttaatcctatccatggagtccctcttttcagcaatacatccgttttaaaaagggaaacgcaggccaaaacccgcgtttccctaaaaaaacgattgcctgtggttttgtgtttaaaagaaaacctcgttttttactggccgcttatttgtgaatcaaatcctttggcatccagtccgctgcagacagataatccagatttccataagtctccccggcaatattgcccaggttctccaccgtggaatcagacttcagcgcatctgccttgatagcagtgcccggaacctcaacaacgtccacgccgctctcaccggttgcagggtcaaaaatcttatcatactggtctgccagctccagcatcaggatacgcatgccaatctcgccgttcatggtccagtcggttgtgcctgctgcggtccagatgtcaggacgtgtctgcatgttggtcacgtcaaccgggtcaatgtcaaccgatgccataggaagtgcgtcgccgtttttgccgttaaagttgtcattttcagcaattgcattgtaaacgccctggccgtacaggtcatagtaagcaatgacgccatccacatcagccctgttcacgccctgcagatatgcggcagtcactgtattggcagagtcaacggaatcctgaagaggctgtacctcgcctacggttacaatcttgcctgcagcctcatactcctgccagccaacctcgcggcggtcaaatgggctgttgtagttaggacctctccaaaccttaatcaggcggacgccctcgccgtacttgtcaatcatctggtccagaagaacggttacaagggatttatcctgctggaacatctgggtaacgccgggaagcttctggtactctccgtcggtgtagaactgtgtgtcaaaggtgacaatcttcatatccggatactgctccgtgatttccttcaggaatacataggagccgtcctggttgccgtggctgaccagaagcccgtcatatcctgcggatgcacaggtacggatggtgtcctgccacttgttgaagtcaccgtcgcagaagaagaaatcaaactttacatccagtgcatcgcaaagggatgcgcaggagtccttccacatctggaaaatggttgcggagggcagaagcatgatataagccaccttcttgcctgccaccgggttctccgctgccgccggcgccgctgtggtatctgccgccgcctcagctgccgtggtctccgctgccgctgccgcggttgtttccgcctttgtctccgctgccgtggtggatgaacctcctgagccgccgcagcctgccagcagggatgccgccatagcggcagccgcaattacactgaccacttttttcatttttttcattgtactctttcctcctttttgttattgatattgtttactaaacaatatattttctttgttctttgtgttaattaaatagtacaacgctttttcctcaatgtcaatatgtctttggtaattttgttattaatttccataaattattgtttttattgtgcattttaattatacaaatcaataaacagtgtgtattatacctttttgtatttgttttttgtttagtaaacatttaaatttcacatatggaattgacccggtttcaaccctgtgatataattcaatctatagtatgattagtaaatcacatggattgttcaatattgtttatcttaaattctacaatccggaaagagagattccatatgaccgtcagagagctggccaagcagattggcgtttcgcccgcaaccatttccattgtgctgaatggaaaaaagggagtcagcgaggatacgcggaaaaaggtgctggaggcaataaaagcctgccagtactcccccccttcccgcaaacctaaaagcggcaaaaatgtgctcctggtaaaatactataaaagcggtatgctggtagaggaaaatcagggattcatatccatgattattgactccattgaggagcagctccgcgcagagcagctgggcatgaccatgacagtggtcaaaaccggcttaaagtcagcccttgattccattgattacagcaagtactgcgggatgtttctgattgcaaccgaggtaatgcgggatgagttctcggccctagattccattcccatcccctttgtggttgtggacaacaccgtccccaaccattactgtagcagtgtatgcatgaacaatgcggaaaatgtccacattgccctccggcactgtaaaaaatgcggacatacccaactgggctacctgggcagcaccacgggggctgaaaactttaacgagcggcatattgcctttctccgatatgtaaaagaattggattttcagtttgacccagagaacgaattccgcgtaaaacccaccatgctgggggcccatgatgattttttcagaatactggagcataaccccaggctaccttcctgcttttttgcggagaacgacaccattgccctgggcgccatgaaggccctgaaggaaaaggggtataagattcccaacgacatctccctgattggctttgacgatataccctattcctccataagctcccccgccctgaccaccatccatgtgcagagaaagataatggggaagcagtcggtcatccagctgatgcagctaatcgaggacccccggttcatgcccatgaagacccagattacaggaaagctggtagaacgctccagcgtaaaacaactggcataatgaaacaaaaattcccccggcctctcgtattggaggaccgggggaatgcggttatgaacaaattttatccgactcattctgtttgcttcttcccttcaggggcttggaggagggcttggacggggacttggaggagggcttatgatgtgccttggcattgcgctttttcctgccgtcttcttttttctggaccagaagctccacatcctgggaatccgccatcttggctgtcttcacagcataaaagcggtcatcctccgatttcttcacccttatttttccttttacaaacccatgttccgggcatacggccaggcagaaataaaatctctgcccatagggaaaccatctcagcttcttgcgcagcatcctgttgcatttcacgcacttcatatctgtaatatccttgtccttaaggatatcttccctggaatcaaactccctggacacatacttggaatactcagggaaatacagccggtattcctcagccttattcctgggaagtccgtaataatccactgacacataggttccaaatgtctccatatccagcgctgaaagaatacggcccgtataataggcatcatccagcgcccggtgaaagggcctctcctcttccatgccctgcagctgcaccgccatatcaagggacaccttgttcttcccatccccgtactgaaggcagtaaagcttctggatatccaggtaaagcagcggccttggaaagggattgggaagcttatgatacgccatattccgctgaagctcggttaagtccatggaaccccaggtacagaagcaatactcctcctgaccgcaccatgccagaaacctcttcataaccacgtcaaagggctctccttcctggcgcagctccgccatatccatgtgggtcacttccgatatcttaaaatgcatctttttatagaccttgggccgaatcagcttgtgaaaggttcctgtctcttcaaaattcccattcagcttcactgctccgatttctataatttcaaaaggaagatgctccactgaatcttcctttccattgggactctggttccattccaaatcaaaaacaatgtaattcatctcttcatcctgtcactatgcaatctcaatttacttacctatcttaccatataggaaagaatatggaaaggggctattgatgtcattgattcccagtatttccaattctgttttatttttaactgtcattgtcctgcccgcgccaacggtatattccacttatatcttcggttaacctgacagcgccaaattgtcaactatatttcatttttatgttgacaatccaataccgactctctataataagtaaaatataacggtaactttcaatgaggtatcctatatgataaaactaatacaagctgcctgccaatggggaaagaaggactatgacggctgggtcattggaaaggcccggtactgtatccgcaaccgggcacagcctgtggcatatgaatgcgttccgcgcaaaagtattcccggatatgtgcagctggaaactgtggcatacagtgcagggggcctgccctgccagacccttgaaatctgccttgtggataccggggattcagggcctgccggacactttaaaatacctgaggcccccaggctttccgccaaagccggctcatccgatacccagacagccggcgctccggcacgggcagacctacctccccctctgactatgaccttttcttccaagggcctgcggcaattcctgtctgtttccggagacaccaacccaattcatcttgggccgggtgcagtcattcccggcctgtggatactcggccggctggatgaaatctacggcagactcagccctgccagaaccctttccatacgtttcctgagccctgtccacacggacgactttgtgcgcctgatgcaaaaaggcaaccgggtaacaggaaccgtgggaaatcttacctgcttcaccatgaccatccatacaccagaccaaaccataaaacggaggtaatcatgaatcagaaatataacaccgtggaactcactaaaatggcactgctgaccgccttaatctgcgtctcagcctatatcgtcatcccccttccctttacaccggccagcctgacggcccagaccctggttgtcaatctcattgccctgcttctgactcccaggcaggcagcattcaccatggtcgtgtacatccttctggggctgaccggcctgcccgtattctccggtgccatcggaggccccggaaagctgtttggtccaaccggcggctatatcatgtcatggattccggccgtcatcctcatgtcatggctaaagggaacgcattacagctttaagcgttattgtctggtgaccatcctgattgggatgcccgtcatttatctggtgggaagcgcctatatgaaattcataaccggaatggactgggccgccacctttactgctgccgtaattccctttattccccttgatatcttcaaatgctttgctgccgccctcattgcaaaacccgtacagataagcctttcaaacgcccagagggcacgataggaggcgttcatggataaggtattcatactgggcggactgcgcagctatatcggcgtgaaaaacagcgcctaccgccatgtacccgcagagcttctgggggcggctgtgttaaaagagctgaccttccggtatcagccagaagaaattgatatgattatctgcggcaactgcgttggaggcggcggcaatattacccgtctcatggcgctggaggcaggactttcagacaccattcctgcctttacattggacctgcagtgcgcctcctccctggaagctgtcataacagccgcagccaggatacagagcggtctggctgacctggtggctgccggaggttttgaaagcagctccacccagcctgtgcgaagctataaccccaaccatccatatacccgcgcctgccttgcttccagtcttaatacaggcggtccggacaattccccggcctacagcaccgccaaatttatccccggtcctcatcgggaggatgtgatgctgcagggcgcggaaaagaccatctgccattaccatataagccccggcgaaatggacgcctgggtgctggaaagccacagacgggctgtcagggcgcgccaggaaggccttcttgaaggcataaccgtccctgtatacggcctcgaccatgacgaaggaatccggccccggctgaaccagcgcctgctggaccgtctgccctgcgtcctgaaagatggccggtatctcaatgccgccaatgcctgcaccatgaatgacggcgccgccttccttcttctctgttcagagcggtatctgaaaaagcataaacttatcccccggttttaccttacaaatgcatatacggccggggcagacccgcttatgagtcctgcctctgtcctgcccgcaatcaggggacttctggaccgcagcggactctccatggatgagataggcgccattgagtgcaatgaggcctttgcagccattgatgtcctggtcaacagggcttatccggatatatcttcccggtacaatcagctgggcggcgccctggcttatgggcatccctatggtgcgtccggcgctatcattctccttcacctgatgaaatccatggagcaatcggaaagtgcccggggtatttgctgtgcagcagctgccggcgggattggaagcgccattcttctggaacagtaatcagcgttcttctcccggatgccatacacagaaaggtgccacctatgaatcacaaggattatctctctattattcagtcaattccggcccacaggacagccctgattgaggacggacagatttatacatatggtatgcttgccggggagtccggacgcatccgttccctgtctcccaaaactgcggccccttctgcggtatgggtcagagagtcctctgtccataatcagctggtacatttcctggcattaagcggtacatcccaggttcccgtcatcctacccgccgatatgaaatgtctgccccatatcccggcagcagagactgtcccggacggggcctgtatgggcgtccttacctccggttcaacgggccagcccaagctgtggtaccgtacccgggaaagctggtcctctttctttcccactcaaaacgcgatttttggaataaccgacaggacccgtctctttgcacagggcagtctggcattcaccggcaatctgaacctgtatctggcccttctgtccgcaggggcggccatcatcaccgcctcccctgtaaatccctctgtgtggcgcagggaaatagaacgccacgatgcagattccctatatcttatcccctccaagctccggcttctggcaaaatacgcctcccatccctgtctcagcatcaggaccatcctggctggttcccaaagtcttgggcgcagggatatggagctgctgaaagccgcttatcctgacagccgctgtatcctgtactatggggccagcgagctgagctatgtcacctggttgacggaccgggaaatgaatgataacccggcctgcatcggaaaaccctttccaggcatagacgtaaccctgaaggacggtgaaatctacgtcagcaccccctactccgccataggcatcgaagggccctggagcgttggagatatgggctatatggaccggaagggctatctgtactttaatggccggaaggacaatgtatacaatattcacggccgtaaggtctctgcggtaaaaatagaaaacgctctgaacgttctgtctgagatacaggagtctgccgtcatatttcaaaacaatgcactgcaggctcatgtggttctctcagagccaactccttcagaccaggatatgtctgccatgcgctacgccataaagaaggcgttgaacggctgcctggaatcctgggaaatccccagagatattatattccatgagagccttccaaaaaacaacagcggaaagacagtcaagaaactgctctccgccaaagaataaaggttctatactgaatgttggggtgtgctgaaaagcacacttccaacatttttttgttgtaataaaatacatctattagaagccttccaaacgcatccatcatcgcagataaatatcacttcatccggcaggtgacataggcaattgaaaacgtacggaaacgcctgcagcggttcatgccggtttctctgcgtaagtattataaacgcagccggaaactcattctgaacgcggatactccactgtacatcactggagcgggattttacaaatcccaccccaacgattgacaaagagcaaaaaaaagaaccacatatccgtgattctttctgagaggcgacgaccggaatcggaccggtgataagggtgttgcagacccgtgccttaccgcttggctacgtcgccatattaacttataaatgaccccaaggggattcggacccctgttaccgccgtgaaagggcgatgtcttaaccgcttgaccatggggccttgcatatataaattaaaaaactccccgagtaggacttgaacctacgacagcgcggttaacagccgcgtgctctaccgactgagctatcgaggaataggttgatgctctccgattccttattatacattataataaaaaattcatcaagtaccttttgaagatattatatgaaaaacctgcattatttatgcaggtaatacataccttcaaaaccacatattgaattccgattgtttcacaaaccactttcccttaaccttttttactaaattaaaaagaaaaataatttacacatcggagtgatgtgaaagataaaacaagtattttcaagcattccggggcaggtactggattttatggttggtgttgtggctggtcttgtatttgacgttttacctgtctataaccatcgtattatagttccagcagttgcgtctattagttttgtggtattttacaagctttcaaagtacatggtctctatagaggagcaagaaatacataggatttgcattaaaaggttacgtggagtccccacaatgattatatatgggctacacccattaatagggcttattgttggaaagatgttagatgtagttggaatcaaaaaattgccgtcatattttattatgttttttcttgtgacttgcattactgtctgtggggcattcataatgaagaaaatctcgattataaattttatctttaatggtaatagaaagtaaaatgaaactataaacttattggtcaagatatacaaaaattattaagtgtttatgataatcaatcgatattggtatgcagaccgctataccaagtagcttactcggtgacctggttcaagtaataagttagctgtatttttaaccgggtatgttgcttaacggccttttggcgaaattttccgagattagtccttgtttataaggaaacgcacaaaggttcgatgagtatctcgccataggaagaaatcgcagcgtcgaaatggttgagtttagcaatatcaatgcctacattaatcatgaggttgtctctccctttcataaagtctgataccgtgatatctaccaaagattatcatcgtagatttaatcgaaataagtactcagagtgaacacaccggcaacatccagcaaaaaaacagttcagataaaatagcggcaacacgctcctgttatatagtcaaactacaggatattttcaaaagtccactgtatctgaatgtattaaaccacagattaaaaaaagaaaggaaatatgttgtttttgcttctataaacatcatacaagaaagaaatgagtgtatttacaggaaaaacattattaattacagggggtacaggttcctttggcaatgcagtattgaaccgtttccttcaaacagacatcggagagattcgaatattttcccgtgacgagaaaaaacaggatgatatgcgccatgagtttcaagcgaagatgccggaagcagcagacaaaatttctttttatatcggcgatgtccgtgatttggcttctgtaaaaaatgctatacacggtgttgattacatatttcatgctgctgcattaaagcaggttccgtcatgtgaattctttccgattgaagctgtaaagacaaatgtttttggaacggaaaatgttttgacagcagccattgaagagggggtagaatctgtcatctgtctttccaccgataaagccgcatatcctgttaatgctatgggaacttccaaagctatgatggaaaaagttatcgttgcaaagagccgtactagccaaaaaaccaaaatatgctgcacgcgttatggtaatgttatgtgcagccgtggatctgttattccgctttggatagagcaaattcgtaatagtaaccccatcacattaactgaaccggctatgacacgtttcatcatgtccctggaagaagcagttgaccttgttctatttgcatttgaacatggagaagcgggtgatattctggtacagaaagctccggcatgcactattcaaacgcaggcagaagcaatctgccagctgtttaacggcaagaaagaagatatcaaggttatcggtatccggcatggtgaaaaaatgtatgaaacccttctgaccaatgaagaatgtgcccatgctattgaccttggacgcttttatcgtgtaccatgtgataagagaggtttaaattatgataaattctttacagagggaaacagagagagggtaaaattaaacgagttcaattccaataatacaagactgctgtctgtagaggaaaccaaagcaaagctagccgctcttacttatattcaggaagaacttgcaaaggataaattgcagtaaaaggaggtgttgtatgaacttattaataacgggcgcaaagggtatgatgggaacggctctggttgctaatttgaaaaatattaaagataagaaaaactgtacccgtccagaattgcatataaatgaaatttatgaatatgacatagaatcaacgatggaggaactggaaaagtattgccagaaggcagattgtatttttaatcttgcaggtgtaaaccgtccggaacatccggaagattttatgaaaggcaacttcggttttgcttctgagcttttggggcttttaaaaaaatataacaacaaggcaccaatcatgctgagttcttctatccaggctgctttagccggaagatttaaagattctgagtatggccattccaaaagggccggagaggagctgttcttttcttatgctgaagagacgggagccaaagtagcggtgtaccgttttccgaacctgatgggtcatagccgtccgaaatataattccgcagtatctactttttgttgggcagtcgcaaatgatgaggaatttaccgtcaatgaccgcagcacagagttggaactgctttacattgatgattttgtggaaggaatgcttgaccttcttgagggaaaagaacagcactgtgagtttgacggtgtagacacggtgctgagggcagacggacgctattgttgtgttcctgggacgcataaggtcacattgggcgagattgtagatttattgcagcagtttaagaaacagccaaggacattgatgatgccgaaaatgccggaaggttcttttgcaaaaaagttgtatagtttatatttgacatatcttccggtggagaagtttaagtatgagttaaaaatgaattgcgataatcgtgggagttttacggaactggtacatactgctgattgcgggcaggtaagtattaatatcagccggcctggtgttacaaaaggccagcactggcataattccaaatgggaactgtttattgtggctgccgggcacggattaattcgggaacggaatattcatacaggagaaacagtggagtttgaggttagcggcgataagattgaagcagtccacatgattccgggatggacgcataatattatcaatttgtccgatacggacaatctggtaaccgtgatgacctgtaatgaaatatttaatccagaaaaaccggacacattttatgaaccagtgtagaggggaaagaaaacgatgagtgagaaatttgccgtaaaaactgattattcggatattcattttaaagataatggaaagctaaaacttcttattattgtaggcactcgtccggaaatcatccgtctttccgcggtaattgataagtgccgtaagtattttgatgtaatactggcccacacagggcagaattacgattataacctcaatgggatttttttcgagaatctgaagatagagagtcctgaagtttatatggatgctgtcggtgatgacctgggtgcaaccatcggaaatataatcaacggttcatataagctgatgaatcagattaatcctgaggcgctgctgattttaggagatacgaattcatgtctgtcagccatagcagcaaagcgcctgcatatcccaattttccatatggaggcagggaaccgctgtaaggatgagtgtcttccggaggagaccaaccgccggattgtggacatcatatccgatgtaaatcttgcgtattccgaacatgctaggaagtatctccatgagtgcggttttccaaaagagcgtgtttatgtgaccggttcccctatgtctgaagtcctgcatcagaatcttgctgaaattgaaagttcagacattcttgaaaagcttggactgaagccttatcaatatatccttctttctgcacaccgtgaggaaaacattgatacggaaaagaattttttgtctttattcacagcgataaatgggttggcggaaaagtatgatatgccgatactatattcctgtcatccccgttcaagaaaccgtattgacgctgcggggttcaaattggacaaacgcgtgatgcagcatgaaccccttggatttcatgactataaccatctgcagatgaatgcctttgctgttgtttcagactcaggtacactgccggaggagagcagcttctttacaagtataggacacccgataccggctgtatgcatccgaacctcaacagagcgtcctgaagctttagataaggcgtgctttgtgttggctggtattgataaaaaatcgttacttcaggcagtggatactgctgtgcagatgcatttggactgtgattatggtattccagtgccggattatacggaggaaaatgtcagcacaaaagtggttaaaattatccaaagttacacaggagtggtaaataagatggtttggagagttgtggactagatatgaaaatttccaaaggaggtaccatgtaccgcttccgcaaatatttatacgtttttctattccttctttccatagctgttatcctgtatgccacattgtaccgtgaatcagggcagggagacataaggctccagcttttttggaccattaaacgtgcctggagagaccattccggctattattggtacttgattttgggtaatatcgctctgtttatgccgtttggtttctttttaactgcggttcttcgtaaaccggactggaagaaaacagctcttacgggctttgccttttcggctgcaatagaggtcactcaggtcctgctggataaaggcttaggagagctggatgatgtgctgcacaatacatgggggagcctgatgggatattgtgctgcagtgatactgggatttctgtttggacggaagaaaaaacggtatgaaggaaatgtgaagggggcaagcctgttctttggaatgacgattttaacctttgccatattaatattgtacaacaggcctgactggaacttacatctgcgcaggcgggtatagaagggcttacactctaaaaaacacttgacaaatcccacaataattattatgcttgataattataaatcaaagcaaacaaaacggtaatgaggaagaggagtacatcataagaaccatcagagagggtagctcactggctgaaaggcggcccgggcagagtatggtggaaggtagcttctgaactggagcagtgaaggatgaaacagaaggtttggcaggcggatatttatgtgctgtcaccacccaaagatacattctgcgtagctgtttccgaccggcctgcgttaaaggcccaatgagactgccggacatccggcaaaacaaaggtggtaccgcggatactccgccctttgccttccctcaacgggattggcagagggctttttatttttccggcatgcaggaccctgatgccatggattgcgcaccaccagctcaatcacaaaaaccatctacccaaaaaggagaacaaaccatgaaggaactggagaaaacctacaacccggcggacatcgaagaccgcctgtaccagaagtggctggacggaaagtatttccacgcagaggtaaaccgcagcaagaaaccattcaccattgtgatgccgccgccaaacattacgggacagctgcacatgggccatgccctggacaataccatgcaggatattctgattcgctataagaggatgcagggctatgaggcgctgtggcagccgggtacggaccatgccgccattgccaccgaggtcaaggtgattgacaagcttaagaaggaaggcgttgacaaggcagacctgggacgggacggtttccttaaggagtgctggaagtggagagatgagtacggaaccagaatcgtgaatcagcttcataagctgggctcctccgctgactgggacagggagcgtttcaccatggataagggatgctctgacgcggtactggaggtttttgtcaagctgtatgaaaaaggctacatctataagggctccagaatcatcaactggtgtcctgtttgccagacctctatctctgatgcagaggtggagcatgtggagcagaacggcttcttctggcacatcaattaccctgtggtgggagagcctggacgtttcgtggagatagccaccaccaggccggaaaccatgctgggagacaccgcagtggcagtgaacccggaggacgagcgctatcaggacattgtgggcaagatgctgaagctgcccctgacagaccgcgagattcctgttattgcagacccgtatgtggacaaggaatttggaacaggctgcgttaaaatcacaccggcccatgaccccaatgactttgaggtgggcaagcgccacaacctggaagaaatcattatcttaaatgacgatgcaacggtaaatgttccgggcccgtattttggtatggaccgctatgaggccaggaaggccattgtggctgatttggaggctcagggcctgctggtcaaggtggttccccactcccacaacgtgggtacccatgaccgctgcaagaccacggtagagcccatggtaaagcagcagtggtttgtaaagatggaggagatggcaaagccggccattgaggcccttaagaacggcagccttacctttgttcctgagagctttggaaagacatatctccactggctggaaggaatccgcgactggtgtatttccagacagctgtggtggggccacaggattcctgcctattactgccaggactgcggagaaatcattgtatccaaggaaacgccatgcgcctgccccaagtgcggctgcacctcattaaatcaggatgaggataccctggatacctggttctcatccgccctctggcccttctccaccctgggctggcctgagaagacagaggacctggattatttctatcccacggatgtgctggtgaccggatacgacatcattttcttctgggttatccgtatggtgttctccggcctggagcagaccggaaggcttcccttccacactgtgctgattcacggcctggtaagggattccgagggacggaagatgagcaagtccctgggcaatggcattgaccccctggaagtcatcgacaagtacggcgctgacgccctgcgcatgaccctgattacaggcaatgcacccggcaatgacatgcgcttctactgggagcgcgtggaaaacagccgcaactttgcaaataaggtatggaatgcttcacgctttattatgatgaacattgagaaggcgggtgaatcgggcgacgtggcgccggaacgccttaccatggctgacaaatggattgtgtccaaggtaaatacccttacaagggaagtgactgaaaatctggacaaatatgagctgggaatcgcccttcagaaggtttatgattttatttgggaagaattttgcgattggtatattgaaatggtgaagccaaggctgtacaatgaagatgacgatactaaggcagccgctatctggacgcttaagcaggtgctgattcaggctctgaagctgcttcatccgttcatgccctttatctcagaggagattttctgcaaccttcaggaagaggaggagactatcatggtttcccagtggccggtttacagggatgactggaagtttgcaggggaagaacagtccacggaaaccatcaaggaggctgtgagagccatcagaggcgtgcgttcagccatgaacgttccgcccagcaagaaggctactgtttatgtggtgtcggaggatgaaacactgctgcagatatttgagtacagcagaagcttctttgcctccctgggatacgcaggcgaggtaatcctccagaaggataaggaaggaattgccgacgatgctgtctctgcagtcattcacaaggcagtgatttatatgccctttgccgacctggtggacattgataaggagatagagcgtttaaagggcgaagagaaacgtctggcaggagaactggcccgttccagaggtatgctgggcaatgagaagtttgtaagcagagcgccggaggcaaagattgccgaggagcgcgcaaagcttgaaaaatatgaacagatgatggagcaggtgaagatgcgtctggcacagcttcagtgatgaaccaggagaaggctcaggataatgggacaggcggcagaaactgcctgtccgcaggaaaatgaaaacagagcaagtcagacacagggatagagagggagagcatagcatgaatcaatcatcaggaaataagccggttatccatgtcaggatgttcggcggtttcaccattacaatggatgaaaaggccatgagcgacagcgataaccggtccaggaaagcctggagcctgctgagctatctgattattaagcgcaggggggatgtgagcatcaatgagctgttccatgccatctggcaggacggtgttcaggataatccctacggcgcccttaaaaccctggttttccgggtgaggaagatgctggaggcagccggcttcccgtcccaggatttgattctgagccagaagggggcctatatgtggaacccggcctgggaaacggaagtggacacagaccggtttgaaatcctgtgccgcagaatcctggacccggaaggggacggggagagggatggggagaaccggtgggacgcctgcctggaggcacttgggctgtacaggggcattttcctgccaaagtcagccgaagagagctgggtaggccccatggccgcctattaccatacattatatcagaagctggtcattcatatggcggaaaaactgattcaggatgaggattatgtccaggtggaggaaatctgccggaaggccattgacattgaccggtttgtggaggatttccactattactggatatatgctgcttatggccagggtgaacaggagactgcgctgtcacggtataaggccaccacggatatgttttaccgggaacgtctgatgacgccttcagagcattttaaggagttatacaaggttatcagcagcagcgagcaggaggttgtgactgacctggatgcgattcaggagaccctgggcactggcggcgccggagagggacatggtgcgtaccagtgtgaatacgctgtgttcaagcgcctggttcagctggagcgcaggggtgtggagcgcagcggtgattccgtgtacctgtgccttttgaccgtgggagacaggaggggacgcacccttaagccggaaatccaggcaagggccatggaacgcctgcgggcgtccatccagaaatcccttcgctccagcgacgtatatgcgcgttacagtgtcagccagtttatcctgcttctgtcctcagctacctttgagaacagtgagatggtcatgaaccggattttgtccgccttcaataaatcctacgtgcgcaaggacgtggcggtgaactacagccttgacgtgctgaaaccctgaatatccggggctattaccggaatatatgaaatatcacggcagtaatacagctgttcggaacagctgcacattcattacatacagcgaggtcagactatgaagataaaaaatgcgcttttgctgctgcttacagcctccatatggggcgttgcctttgtggcgcagagcgttggaatggattatgtggggccatttacatttaactgcgtcagatgccttatgggcggtgttgtccttcttccctgcatatggttctttgacaggaagaataagaggaaggaacaggtcccggccatacccggggccaggaagacactgattacgggaggcatactctgcggcgtggccctttgcctggccagcaacttccagcagtttggaatccagtacaccacagtgggtaaggccggatttataaccgcctgctacattgtcattgtccctgtactggggcttttattgggtaagaaatgcagccccgtggttgccggggcagtggtcctgtccctggccggcctgtacatgctgtgcatgaacgggggagaattgtcagtgaacaaaggggaccttctcatgctggtatgcgcctttctctttgccctgcatattatggttatcgatttcttttcccctgttgtggacggggtaaagatgtcctgcatccagttttttgtcagcggcattctctcaggcgcagccatgctggtctgtgagacgcctgacatgagccagattatagccgcatgggcgccccttctctacgcaggcatcatgtcctgcggcgtggcctacaccctgcagattgtgggacagaagggcatgaaccccacggttgcttccctgattctgagtctggaatccagtatttctgtcctggcgggatgggtgattttagggcagaagctgtcttccagggagatactgggatgcgcccttatgtttggcgctatcatactggcccagattccggtgggacgccgcagggaggcatccctgaatacagagggcagctgacgggaattctgtcgcatcctggcgaagggcggcgagaatatccggttgccaattgaatcaaattaggttaagattataaaagcctgtccggcagacaggcttttaagaaagaatggactttagttatgggacaagcagaggagtatttggaccgcattcccatgtggaccaggaaaaagaattcattggaggatgtcaggcagtttttggattacctgggaaaccccgaccgggacagacctgcgattcatgtggctggaaccaatggcaaggggtctgtgtgcgcattccttacatctatactgagggaagccggttacagcaccggtacctttatctcgcctcatctggtggaggtgcgtgaacgtttcctgattaatggaaggatggtggaccaggaaagctttgaagcggcttttgagacggtccttgaggccagcaaaaagcttgcaggccagggactctgccatcccactttttttgaattcctgttttatatggccatggtcctgttccggatgcacgatgtggatgtgatgattctggaaacaggaatgggcggcaggctggataccaccaatgtgctggaacaccctgcggcctgtgtgattacctccatcagcatggaccataccaagtatctgggggacaccctggccaagattgcaggggaaaaggccggcattatcaaaaccggggtccctcttatatttgataacggacagccggaggtatccaccatactggagggctttgccttccgcaagggtgcagcccgatatccggtgggccgggaggatttccatgtggaggagataggcgaaaagggcttgtccatcagtgcaagaatgaaggacggcagatgcctggaactggagattccctttgaagcgttttatcaggcggaaaatgctatgctggccgtccgcaccctggatgtactgcgccatcccggagaatgtcccaggacaggctgcaggatgccgggccatggtccctgcatctgcccggacggtatggaatggggaataacggaccggcatattgctgctggtctgaagaatacgttctggcccggacggatggaacaggtgcggccgggaatctatctggacggcgcccataatcctggagggattgaggccttcatacagacggcctgggagatatcagacagacagggaaagaagccgtggctgctgtttgccgctgtttcggacaaggattatgagcgtatggcggaacagctgtgcaaagagatgatttgggaagcagtcggcgtggtccacatgaacagcgacagaggactggctgccaaagaactggccagggtattccgcacatatacgtccaggcctgtgtactcatacggggacaccgggagcgctgttaaggatatgacggagaaaagccgggaaggactattgttctgtgccggttccctgtatctcatcggtgagattaaggcagtgctggagcagcagtcctgacaagataggagtgaaatacatgattgattttgaagaggagattgagcgttttaaaccaagcctggatgtggaagaggtggaggacgccattgttaaaagcgatttgacagatatgacggacatcatgatggaactgataaaagaaagaggcgagcgggacctgtgaatacagactatgcaagaaagaaccagcagatagccaacagcttctacaacctgggcctggaaaaggccaggatacgggatttgtccggcgcggcccagtgcctgaagaaaagcctgcattttaataagtatcagacagatgccaggaatctgctgggattgatatactatgagaacggggaagtggccgatgcactggtacagtgggtcatcagcctgaacctgcagccggaggataatctggcggaccattatctggatgagattcagagaaagccggggcagctggagatggagagccagaatgtaaagacattcaaccaggcgctctggcatgcacaaaacggcagcgatgatttggccatactccagctggccagggtggtggagtccaatccccactttgtgaaggcccatctccttctggccctgttatacatggccagggaggattacaataaggccggccgttccctgtataaaattcttcagattgacaagagcaaccagaaggccctgtactacatgtccattgtaaagcagaacacaggcagggcggatgcagagaagcgcaagatggtgaaagcattttcccatcgtaagatggaggatgacgatgtcatcatccctaatacttataaggaaaccacaggcatttccactgtgttccacatcatcattggactggttctcggcattatggctttttatttcctcattctgcctgccagaacaagggaccttaacagcatccacgacaacaacctgaaatcctatatgcagaagctcaacaatgcaaatcagcagtacgatatcctgaaggcggattacgatgagctggatgcccacacaaaggagattcaggcccgtctggacgagctgaccacaggcaacaccagcgtcatagcccagtaccagggattgatttggattctccaggactacaggagcggtgatttggtggcggcggccaaggcatatgccggagccagctttgatttgattgaggacgaaaatattcaggccattgtggaaaatatccgtcaggatatgacggcaaatatttaccagagcctggtggacaggggacttcagctgtggaatgcaggcaataagacagaggccatggactatttccaggccagcctgaccataaggccggataatccggaagccctgttctatgtggggcgtctgtaccaggatgccggcgacacggataatgccaattccatgtttgacaaagtggtcaatgaattcccggattccgactatgtggaccgggcaaggaatgccaggggttattaatttaaacggtttttcaggaaagatactacagaagataagatataagtcttttgtggtatctttttttgtattttataagcgctgagaaaggagtatggagggatggaacagacaacgtttacgtatgaggccagggagcagatgctggtgattcaccttccgggggagctggaccaccataactgcaggaatttgaaacgggatacggacctgcttctggcagagaactacatcaacaggattgtatttgattttacacacacatcatttatggattcatccggcatcggggtgcttttaaaccgttataagcagatggcagccagccggggaaccgtggcctattacggggcagggcctcaggtcaggcggatactggagatgggcggggtaagccgcctaatcaagggctatgaagacagggaatcagcaataaagggatgaaaaagatggaggataagaaaatggagacaaacagagaacatatgaggctggagatggagagcctttcccggaatgaggaatttgccagggtggtgacagccgtgttcatgagcaggctggaccccaccctggaggaggtggatgatgtgaagacagctgtatccgaggcagtgaccaatgcagtcatacatggctacaagggcgggcagggtaccatatatctggacctgactgcagatatggaggaacacaccctgaccgtggcagtgaaggactgcggtgtgggcatagcggatgtgaaacaggccatggagcccatgtttaccacggacccggagggagagcgctccggcatgggattttcctttatggaggcgttcatggaccaggtagaggtggagtctgaaccaaatcatggcacattggtgacaatgaagaaattcatcggcaggtgacggcgatggatgagaccatgaaattaatcaatatggctcacgaaggggataaagcggcaagggaccggctggtcatggacaatgtggggcttatatggagcattgtcaggcggttctccggccgggggtatgagatggaggacctgttccagattggaagcatcggactgattaaggccatcgacaaatttgacactggatttgatgtgaaattttccacctatgcagtgcccatgattacaggggaaatcaagcgtttcctcagggacgacggcatgattaaggtcagccgctccatcaaggaactgggggttaaggtcagggctgccagggaggaaatgacgtacagtctgggaagagagcccaccattgaggaaattgcaggcaggctggggaccagccgtgaggaggtggccgcatccctggaggctgctgcggaggtggagtcgctgtaccgccctgcggacagcggggatgagaattccacctatctcatggaccgtctggcccaggacaacaatgaccatgaggatttgttaaaccgaatggttttaaaggatttgatggagggacttgaggaagagcagagggaaattatactgcgcagatatttttacaatgagacccagacccagattgcgggggagcttggcatttcccaggtacaggtgtcccggctggaaaaacgtatattgaaagaaatgaggaaaaaactgtaaacaaaagccgcaaggtataaaaagttccatggaagttatactagataccagaaaccaattaacatttttgaaaaggatgtgattcttatgggttttggtaaacgagtatgtgaactgcttgcagtcatagcctcccttctcctgataggggtcctgatatggtatctgtcctcaggtttcggagacaggggatatgaaaaggaagggacgctggtgtgggaggagatggatgagccttccatggaagaggaagtttgtccggcctttgtgactgaccctgtgtccatgatgtacggacagcaggaaatccaaaggagcggaaaaggtctatgaaccatacagtctatttaaaactaagtcaaatcacggagctgacccacaaggacgttgtcctgaaggacgttgcccaggtttactgcgacgaccagaatgtgatgaacaaatgcaatgccatgaaggtcatgaccgtgaaggtggatgccaagcgccgctatatagtaagcgccctggacgtaatcaacaagctgaaacagctggactccaccattgatgtaaacaacgtgggggaggcggatttcatcattgcctacaagccgccttccccgcctgcttacgtctggcagtggaccaagaccgtatttgtctgcctggtgtgttttttcggcgccgcatttgccatcatgacctttaacaatgatgtcagtgttaccgatgtgttcagcgaggtgtacaggctggttatgggttatgaatccggcggtttcaccgtgcttgaggtaagctattccgtgggtctggctgtgggcatcatcggttttttcaatcactttgcagccataaaactgaatacggaccccacgccgttagaggtggaaatgcgcctttatgaggacaatatcagtaagaccctgattgccaatgacggcagaaaggagtcaaaaattgatattacttaaaaaatgtctgctggcgttcttcggtctgtgcgccggcggcatcattgcagccggcgtatatgcgttcctggccatcataggcgtgtttgtgcgcctcatgggaaagacaggcaccaggaagcatatttttctgtatgagacagttattattctgggcggtgtcctgggaaatatactggatatttatgagtttcccatttatatggggccttatctgggcacccttttcatatgtgtattcggactgtccgtagggattttcgtgggctgtctggtcatgtccctggcggaaaccctgaaagcccttccggttatcagcaggaggattcatctggctgtgggactgcagtatattatatttgccctggcagcagggaagatggcaggagccctggtctatttctggaaccgtatggcttcccttggatgacgaggccaaagagggcgaggccaaagaggatgaacctaagaggatgagccaaaaaggtttagggctgtccgcagccggattttgagaggagtaaacaaatggagattgataagaaaaagtatgaggagtacgtgaaacaggtgactcccacccacagcctggcaaaaaacatggcagcggccttcctggtaggcggaatcatctgtgtgctggggcagtttgccctgaatttcatgatgaacaacatgggcatggaccaggagacagcggcggcctggactctgctggtattgattctgctgagcatcctgctgaccggattcaatatatatccaaagattgtgaaattcgggggtgcaggagccctggtgcccattaccgggtttgccaattccgtggtggctccggccatagagttccatgcggagggcgaggtgttcggcgtgggctgtaagatatttaccattgcagggccggttattttgtatggggttttgaccagctgggtgctggggctgatttactgggttgggattgcagcggggattttttaaatctaaaagaaggtgtggaaagagcagagtaataagaggaggtatccgcttattattctgttttttcgtaatataaagttggggcagcctttttgtgtaaatagagaatgaatcatcagatataaccccagaaaatggactggaaaaaattccctggtccattttccattttatggggacagacagttgactttttacaggttctctgatatcctatacgggttagcgtaggctaacattaaacggaggagggttcgcattgaagtacatatggattaacccagtggcagagaacatgtatcacagagaggcattggcgtgtttcctgaaaaagcacggatttgtgcaggtacggtgcaatacagactggggagctgttgttaagggaaagtacaagtcccagatagaagcgggcagggggacggtggcggatatgcggtgccccatggcaggcaggatggcggcggattaccggcagaggcggggagccgggcagcggggagacagccttgtgataccggatattgaaccaatcctgattcactgtgccagggaaatcagcgggagaagggacctggaagacggcctgaaaatcataaccacgccctgccgggcgctggcggatgcaggcaatgccttaaagcttaaagacacaagattcctgacctggaacgggcttttgcgggaactgggtgaaaccgtggcagatgcctgggcggaatgcgctgcttatgggaaggcggctgtaccgggaggcgctacacgatgcctgaagtccagccctattccgcctggtttttttgaggatttggagacagatacaatcagtttgaccggagaagaaaccataagactataccttgaaaaggaatcctggaagcaggtcaggctggtggagatgctctactgtgatatgggatgccacaatggtgatggagtgatggcagatgaagaataggtggaacaggtcaatggcccccctgattggaataggggcaattctgcttatatggtacggggtctgccgggcggatatgttcagcgcctatgtactgccgcctccctccagggtgttccggagtttttataagatggctgtgaacggtgagctgtggaaggatatttttatcagctttgtcagagtcgcaaagggattttccattgcttttgtgctggcctttggtctggggatggtacggattctgctgccgggaaccagcggatattatgagtatgtggtgcagtttttcaggaatgtaccgcctctggccatgattccgctgctgattctgtggtgcgggattggggagacaaccaagacagttatcattgtcctggcatcctttttccccatgtatctgaatattgtgaagggatttacggggtgtgataaaaagcttttggaagtgggggaaatgttcggatattcatcaggaaggaagttcctgaggattgtactgccgtacgctgcatccgatatactggtgggaatgcgtatcggccttggatacagctggcgggccatcatcggagctgagatggtggctgcttccacgggcctgggacatatgattctgtttgcccagcagatgtccaggacagacaaggtcattgtgggaattctgaccattggcgcggtgggatacgtgacggaccgtctgttcggttttgcaatcagtaaaatgttgaaaggaacctgtgacaatggctgggattaagctgaagtacatttataaggagtatagggtggaggacaggcctgtccaggtgctgagaggtatcagcctggatataccggaggaccacattacagttattctgggcaggagcgggtgcggaaaaaccacccttctgcggcttacaggaggactggagaaggctgacagcggggagatacagtatgagggctgccacaggaccgcctatgtatttcaggaacccaggctgatgccctggctcactgtgtgggataatgtgacctttgggctcaggaagaaggagcaggacagggatactataagagatattataaataccgtaggattggaagggtttgaaaaggcatatccgtcccagctgtcaggagggatgcagcagcgggcagccatagccagggcgctggcataccgcccgtccttcattatgatggacgagccctttgcagccctggattattttaccagggaacagatgcagaaagagcttttgcgggtccggcagaaactgaggtgcagcatcctgtttgtgacccacagtatcgatgaggcgctgcttctgggacacaggattgtggtcattgaaaacggacttgtcaagacccaggtgcaggtaccggagacggcaggggacaggaacctgatggatgatatgttcatctccctgaagcggcgtattattgagagcctgaacgcaggggactgggaactggagctatatagcaggaatagacagacataaaaagacagaataaggagaaatgaaatgagaaaatttatagcattagggctggccctgtgcatcggggcatccgcccttaccggatgcggcaaggcatcggcaggagcagcggaggcagatgcccggcaggatgccctggaagatacacagtcaggaggaaacaaggcttcctccggtctggacaagctggcgctcacttatgttacctcgccgctcaacgttcctaccatcattgagcgggaccaaaatatatttgcagatgcattcagggacatgggtatttccctggaatatgcggaaatcaattcaggagccgaccagacacaggcgctggcatccggggacgtgcagattctttatggggtgggagcaacctctgttatcctgtctgctgccaacggggcggatatcaaggtgctgaacatgtacagcaggtccccaaaggcattctgcatgtactctgcagatgacagcctgactaccccggagagtcttaagggaaagaccattgggggaccggcagggacgaatctccatgagcttttagtatcgtatcttgcggctggagggctgaccatggatgatgtgaattacgtgaatatgtccattgcagatgccaaggcggccctggacggcggcagcgtggatatagccctgattgcaggagcagccgcttatcaggcaaaggagcaggggtatcacatggtggctgatggggagggactcatgaaagctatgattgccgtggctgtcagagatgatttttataacgaaaatcaggatgtgatagaccgctttatggaagcccagaaccgcgctgccgcatttatgaaagacaatcaggagcaggcccttcagattgcagccagggcactggatttggatgaagaggcagtaaaggagatgtatgccttctatgatttttccatggatgtcacggatgaggataaggaaggattccaaaaaacagctgatttcatgctggagtcaggcatgatagaggaagaactggatgtggatggtttgttcttataagcttgagcgtaaacggtattacgattttggttgatataacaaaggtaacatccattccggacaatattccggaggatgcaaaagaaatggcctacagcagcaaaaaacagggacacgtctgtcatttgacggcggtgtcccgttttgttctgttcttctgtttcactggttttctgccatttttatggctgcagtgtttttattaccatcttcatcacttcatcttcggcttaaatataagggatgccaggtagccaaacaccagggcgccacatattcccgcggagctggccgtgagtccgcccttaaaaatacccagaatgccgtcctctccgataccttccttcacgcccttccagagggtgtttccaaagcccagaagaggcacggttgcgcctgctcccgcccactttgcaaaaggttcatagagccctatggcacccagtatggcgccgctgaccaccagggtgaccatgacccgtcccggcatcatcttggtcttttccagcagaatctggaccagggcgcagataatacctcccacgataaatgcttttatatagtccatgtcatttcctccttaactgtctatatgttcaatgacgaccgcatgggcaatgcccggtatgctctgtccttcattgaagcttaccgaggacagaagggctccggtgggaacaaataaaacccgtttccaggtgccgtcctgtaccttggggaggatgtaggagcacagggtaacggcggaacagccgcatccgctaccgcccgaatgggtgtcctgctgttccttgtcataaatctccataccgcagtccatgtgaagctggcttaaatcccttcccttattcttcatgaactccagcaggatggtccttcccacctcgcctaaatcaccggtaatgattttgtcataccaggtctcattgacctggaagtcctccaggttctgttcaatggtatggaatgcagccggggccatggcagctcccatattcatggaatccttggcccccatgtccaccatacgcccggttgtgatgcctgcgatgcgggccattccgtctttccggttgcctgccagaacaaccgcgccgcagcccgtgacagtccatgtggctgacggcggcctctggttcccataagctaacggaaaacggaactgcttttccgccgtggcaaaatggctggatgccatggacatgacctggtccgcatatcctgcattgactgccatggctcccagtcccaatgcctctcccatggtggagcaggccccataaaggccaaaaagaggaatctccaaatccacggttccaaaggacgttgctatgagctgtcccagcaggtcgcctgcaaacaggtaacgcagctcaccctttcgtatgccgcccttctcaatgaccaggtctgcagtttttttctgcatggtgctctcagcctgttcccaattatccataccaaacatatcgtccagttccacctcgtcgaacaggcttcccagaggaccttccccctctttttttccaacgacggagccggcacttataatgaccgggggatgttcaaattcaatacttgccttgcctttcatctgtcccatttcatgcactctccttcctgtaacaggatgtaatagttacagtatccctcgtttccggaaaaatactcaaaaataaataaaccggaaaagctggattatttgcttttccggttcatataaatttcattttaaatttcaagtatccgggaccaatcctagtaaggacggttccccggcccaaacccttccgtggtttccggcgaggtctggtatcccggaccgatgggtgtcacggtgggcccggtatttccaaaatcatccgtattgggcggtatgatggtggatgcgtcggagtggatggtgcagtagcctgggatggcaaatacggaatcatccgttgcgccttcctcgccctccggcagggtcatgcataccctggtggtctttgtggggcagtatggggtggggcgcatacctgactcagcgcatacggtaacctccacatgcttgtcacagacctctgtgggagcggttccctttgcaaaatattcggtgtacacagcattgcctctggggtcgtggttgcagacgccggagacagcccgtttaccggatttgcggcagatttccgcagtctcaatgctgtcaggcactgcaaagcccgggtccggcatgccttcgtggacacggttcatgatgttgcgccagatgtccttgtggaaggtcgttccgccgttgttcacgccgccgtgctttagcttctggttgttgtcgcatccgccccatatgcctgcggtgtaatacggcgtgtagcccacgaaccatacgtcgttgttgttggaggtggtgccgctcttgccggcagccgtcatgcctgtcagggctgcgcgggtgctggtggagttgatggacacgccggggcgtgtgaatttgcggttgctcttcatggattccgacattgcgtccgttaagaggaaggcggtggaatccttcagcacctgctttgtctcaggttcattgtctatcagtacctttccgttgtggtccagtatctttgtaaagaagcggggctttgtgtacacgccgccgttggcaatggacgcataggccgtggtcagttccagattggaaacgccctttgttatgccgcccagggcagtggctgctcccaggtcatcctttgtgagggaggtgatgcccatgttctctgcatactccacgccaagctggggcgtgactgtctccatgaggcagcgcacagccacaatgttcatggagtagatgatgccgtcgcggatgctggagtaaccggtaaagccatagccggagttccaccagttcctgaagcttttggttccgatggtatagggcgcatcgtagtagaccgtgcccagagtggcgccgcaggcgtccagggccggtgcaaaggctgtgataaccttaaatgcagaacccggctggcggtatacgttgctggcccggttcagggtcagactggccttcttttcgccgcggccgccgcacagcgccttgacttcccctgtgtgctggtccagaagcacaaaggatgcctggggctgcagaatcaggttctggcgctcgccgatgatttcatcgccgtcctttaaaagccatgccttgtactggtcaatgtcgtcctggaccgcttccttggaggcgtagagtccctcgaaggaggaatctcccagcacgctcttgcggaaggtgcgcaggctgtcttctgaatagtgctccgtggtaccgtccccatgggtaatggaaagcctgtactccaccgaatacttggccacggaatagttgtccgggttattgatttcctcgtccacaatggcctgtagggccgggtcctgggtggtataaatctggagtccgccggagtagaggagattgctggcctggctttccgtgtagtccagcttttccatcagggaattgatgacctgctctatcagctcgtccgtaaaatagctgtaatgggtattggtccccttggtggccgtatccacgttctgtatcctgtcgtatacatcatcggccagggcctcctcctgttgggccttggtgatataatcctgctcatacatatactggagtacgattctgcggcgttccgcattgttttcgcgtcctgatatggggttgagtttggaagggttcttggtgatggatgcaagcacggtgcactctgagagggtcaggtcggagacatccttattaaaatagcgcttggcagcaacctttactcccagggtattgttgcccaggttgatggtgttgagatagttggtgataatcagcttcttggtatcttccttgctcattcctgagttcttttccagctgcacggcaaggtactgttcctggagtttacgctcaatcctggctccccagccggattccataccgccggagaacacattgttcttgatgagctgctgtgttatggtgcttccgccgcctgcataatcgtcgctgacaattccctttacagccctggcaatggaacggatgtcaatgccgttgtgagtccagaaacgggaatcctcaatagctacaaatgcattaatcaaatcctttggaagctcctcgtaagtggcttcctcccggttggaaccgctggtgaccagggtatctgtcaggttcccggcagcgtcatataccgtggtggcaaaacggctgggctgaatatttagaatatcaacggaaggggcattgtctataatgcctttaaccataccgaaaccgatggatgcacccactactgccagaaacaaaaacaggacaaaaagcgccttaaatatattaaggagcagccgtgaagcgtatttgcctgatttagagtggagagacttaagcctacgctcagcctcgtactttccatagttcatagattctccttttcgtacataatctgaatggaatccgcccccctgcggaccctcatacctatcctgtagattatacaccagttttgtaaaattgaaaaggtttaaatatgcccttgccatcgcctgctatctatattatgataaaaatcaggtaaaaaatgtcgaagggtggggatgagaacccacaaataaccgtaaaggagccgtaaaagtggtagagagttacaaaatcctgtacaagggaggcacaggggagctggtggagaagaagtcccgcttcctggcggacctgcgcccggtgtcctcagaggaggaggccctggcattcatagaggaaatcagaaagaaatactgggatgcaaggcatcactgctttgcctatatcatcggggacaggggacagaacgcccggtgcagcgacgacggggagccgtcccagacagccgggaaacccatgatggacgtactggcaggcgaggagcttcacgatgtgtgcgctgtggtgacgcggtatttcggaggcacgcttcttggcactggcggtctggtgcgggcttattccggcgcgttaaaggaaggacttaagaactgcgttattctggagaaaaaactggctgtccgcctggaggtcaccacggattacaacggggtgggaaagattcagtatattgctgcccaggcaggaatcgataccctggatacgcagtacacggataaggctgtgttcaccttcctggtacctatagcggaggagggacgtttcacggcccagattacggagggaacggccggaaaggccatcatacggagagaagatgaggtatactacggtctgggggacagcggactggtggtgttttaggaaaatggcgcatttggataaaccatgcttttagaataagcgtgttttggaaagaataggaggaatagatgatggaaatgaaaaagctgggatttggaaccatgaggcttcctttgctgaatcaggaggaccctgcatcggtggacctggagcaggtatgccggatggtggatacctttatggaaaggggatttacctattttgatacggcttacatgtaccacaagtatgagagtgagcgtgttgtgaaaaaggccctggtggatcgctggcccagggacagctatgtgctggcggataagctgcccctcagccatctgaaggaggaggcggacatggagcgctttttccgggagcagctggaaaagtgcggcgttggctattttgactactacctgcttcacaacatgtccaggacgtattatgagacagctgagcggctgggggcgtttgatttcgcacgcagaaaacagcaggagggaaaggcggtcagaatcggattttccttccattcggatgctgagcttctggaggagatactggagaaacatcccgagatggagtttgtgcagctgcagcttaattacatagactgggacagccctgacatacagtcccgtcagtgctacgaggtgtgccgcagatacgggaaggacgtcattgtcatggaaccggttaagggcgggaccctggcggatgtgccccgggaggccggagcactgatgaaggcccatgctccgggtatgacccctgcatcctgggcagtccggtttgctgccagcagggagggggttatcatggtgctgtcgggcatgtcggattacagccagctcctggacaatacggcttacatgcaggatttcgttcccctgactgaggaggaggagcggattgtggccagggctgcggacattatccagtccgccacagccatagcctgtaccgcatgccagtactgtgtggagggatgtccgaagcagattcccatacccaggtatttttccctttataaccagtacagtctttttggtgagaagtccaattccaggggctattaccagaattatgcggccagatacgggacagcaggcgactgcatcggctgccgcaggtgtgaggccatatgtccccagcatctgcccattgcacggcatatgaaggaaatagcagaggtgtttgagccggctaaatagggcgccggataaaggaaaatcaacgggaataagcggaaatggtgcaaaatcccttgcaatctgtacacaccaatgctatactataaaaccgtggctgtagacgtatataataaggaagagtaatcactatgaagatgaaaagagaagatgtaagaaatatcgctatcattgcccatgtagaccatggtaaaaccacattagtagaccagctgcttaggcagagcggcgtgttccgcgtaaaccaggaggttcaggagcgtgtaatggactccaatgacctggagcgtgagagaggaatcaccatcctgtccaagaacacggctgtattttataaagacacaaaaatcaacatcatcgatacccccggacacgctgacttcggcggcgaggtagagcgtgtgctcaagatggtggacggcgtggtactggtagtggatgcctatgaaggacccatgccccagacaaagttcgtgcttcagaaagcgctggatttgaatctgtccgtcatcgtgtgcatcaacaagattgacaggcccgaggccaggccggcggatgtcattgacgagacgctggagctgatgatggacctggatgccacggatgagcagctggactgcccctttgtctatgcatcggccagggccggatttgcaaaatacaagattgaggacccggaagaggacatgagtcccctgtttgaaaccattataaaccatatcccggcgccggagggagatccggacgcagagacccaggtactcataagcaccattgactacaatgagttcgtaggccggattggcatcggacgtgtggacaacggaggacttaaggtgaaccaggagtgcgttctggtaaaccaccacgagccggataaattcaggaaaatcaagataggaaagctctatgagtttgacggacttaagagggtggaggtgcaggaggccggcattggttccatcgttgccatctccggtattgcagatatccatatcggcgataccatatgcacccctaataacccggagtccattcccttccagaagatatccgagcccaccattgccatgtacttcatggtcaatgacagcccgctggcaggccaggagggcaagtatatcacatcccgccatctgcgcgaccgtttattcagggagctgaacacagacgtgagcctgagggtggaggaaacggattccgcggactgcttcaaggtgtcgggccgcggtgagcttcacctgtccgtactgattgaaaatatgcgccgtgagggctttgagtttgctgtcagcaaggcagaggtgctctataagtacgatgagaggaaccgcaagctggagccaatggagctggcttatgtggatgtgcctgaggaatacaccggcgttgttatccagaagctgaccagccgcaagggcgcccttcagggtatgagccaggcagcaggcggctattccaggctggaattttccatcccctccagaggacttatcggttaccgcggtgactttatgaccgatacaaagggaaatggtatcctgaacaccatttttgacggctactcagagtacaagggcgatttgttctaccgtcagaccggctccctcattgcctttgaggcaggcgaggccattacctacggccttttcaatgcccaggaaagaggcaccctgtttatcggaccgggcgtcaaggtgtactccggcatggtggttggacagagccctaaggcagaggacattgaaatcaatgtctgcaagacaaagaagctgaccaacacccgttcctccagtgctgacgaggcgcttaagctgacaccgcctaaaatcatgagcctggagcaggccctggacttcattgatacggatgagcttctggaggtaactccggagagcctgcgcatccgcaagaagatactggacccaaccctgcgcaagagggcttctttcaagaacaaatagataaaaatcgacattttgtaagtgaaatggcgaatcctgtcgaacgattctggcgggattcgccttattttttgttctattatggcatttcccctcataaactatcaatgtgccgtacaaaagcaagagaataaaaggatgaaacaagtaaaacggcagaatgagaaatatttagaagcgaagaggagatgtactatgtcagaaaaaatgattgaaaacaacagggtaagcgttatcggagaaatcgtgtcgggatttaccttcagccatgaagtcttcggagaaggattttatatggtggatgtggctgtcaacaggctcagcgagcaggcggacatcattcccctgatgatatccgagcgccttatagacgtacataaagactattcaggctgtaccgtggaatccttgggccagttccgttcctacaaccggcatgagggaatcaagaaccggctgatgctgtccatctttgtaagggaaattcattttattgaggaattcacggattacaccaagaccaatcagatattcctggacggctatatctgcaagccgcctatttacagaaaaactcctcttggcagggaaatcgcagacatacttctggctgtgaaccgcccctacggcaagtcggattacataccctgcatcagctggggacgcaacgcgcgttttgcatccagcttcgaggtgggcaccagggtaagagtgtggggccgcgtgcagagccgcgagtacaccaaaaaactcagcgagacagagtgcgagaagcgcattgcatatgaggtttccatcagcaagctggaatgtgacgaggcttgaactgaccaggctgcagacgctgctatctaacaaatccttttgaatatctttcgaaaaatgtaagaaatatttgcaatattggctaaactatgctattatgagcaagtccaattgttcttaagacaaagcaagtaaagcatgaggtgcaagatgatgaaagagagcatgatacaggttatctgcggaccgggacggggcaagaccaccagtgccattggcagggggctgactgcgctgaccaagggaaagtgcgtctatatggtgcagttccttaaaggcgccctggatgtagataacatggaaatcatacagcgtctggaaccggaatttaagatattcagatttgagaaaacccctgttttctttgaccggctgacggaggaagagaaggcagaggcaagaatctgtatcctgaacggcctgaattttgccaggaaggttctggtgacaggggagtgtgatgtgcttatcctggatgagattctgggaatcctggatgagggtgtgatatcaggcgaggagctgtgcgccatcatagcccaggccaggaatgggcagatacagttaatccttacagggaccatatatccggagtgcctggatggccatgtggatgaggtcacaaggatacagacaagatatgagtgatttcctgttgacagactgttggcagggtgataatataataccaacaatcatagagtagaggttgcgttaatcatgagtaggtaagccggatgtggcaggcacaggcgatggcttagggaaagggagagacgccgaagaggaagcgttccttgtttacgccccctctgggcatatggttaagagccgtatgactgtcatccgggtggatggagagctaccaaagaacgtggatttgacactggaatcatacgtatatggaagggctgacatttacctcagcccttttttgtttcttgggaaagtacgtccgggtttcattttctatggggaaaagcacactgtgattgaatcaagagaaaaggagagaatatagtatggcactttttgaaggagcaggtgtagcactggtaaccccgtttaaggaaaacggtgaagtgaattacgaaaaactggaggagattgtagaggagcagattgcaggcggcacggacgccatcattgcctgcggcaccacaggcgaagcctccaccatgacccatgaggagcatctggatgtaattgagtacatctgcagggtgacaaagaagcggattcccgtggttgcaggaaccggctccaactgtacggagacagcaatctatctttcggcagaggctgagaagagaggggcggacggacttcttctggtgtccccgtattacaacaaagcaacccagaaaggacttatggcccactttacagcggttgcagatgcagtgaagattcctgttatcctctacaatattcctggcaggacaggcgtcaccattaagcctgagaccattgcggccctgtgtaagaacgtggacaatattgtgggcgtaaaagaggccagcggcaatttttctgccattgccacccttatgagcctgtcagacggaacggtggatttgtactccggcaatgacgaccagattgttccccttctctcgctgggaggaaagggtgttatctcggtgctgtccaatgttgcgccgcgccagacccacgatatctgcgcgtcctattttgcaggggatgtaaaaaccagcgccagccttcagttaaaggccattccgctgattacagagctgttcagcgaggtgaaccccattccggttaaggctgccatgaacatgatgggcaagggcgtgggcccgctgcgcatgcctttaactgagatggagccccagaatcaggagaagcttaaggctgccatgacagcttacggcatcctgtagggaaggtttcgggaaaggacggtataataccaatggtaaagatgataatgcacggctgctgcggggccatgggacacgtaatctcagggctggcggcggaagatgagagaatccgcattgtggcgggcattgacgtccgggaggggacggatttgggatatcccgtgttcccttccctggaccagtgcgatgcagaggcggacgtgattgtggatttcgcgtccccaaaggcagtggacgggcttctggcttacagctgctccaggcagattccggtggttctctgcaccaccgggctttcggaggaacagcttgaggcagtgggaaaggccagtgaaaagacagccatcctgcgctccgccaatatgtccctgggagtaaacctgctgcttaagctggtgggggaggcagccagggtgctggcgggctccggctttgacatggaaatcgtggaaaagcaccacaaccagaaggtggatgcgcccagcggcacagccctggccctggcggactccatgaaccaggccatggacgggcagtacgcctatacctgtgacaggagcaccaggcgtgagaagagaaaccctaaggaaatcggaatctcgtccgtcaggggcggttccattgtgggcgaacacgatgtgatatttgcgggcagagacgaggtggtgaccttcagccacacagcttattccaaggccattttcgccaaaggcgccctggaggcagccaaattcctggccggaaaggaacccggcatgtattccatgacagacgtggtgggtttataacagaaatttccagaatatgcaggatgttccaccataatccattctcctaaagcacataatataggtagaaaacgaaaggagaatgtcattatgaaaaaaatcagacctgcaatatttgcaatgctgctgctcatcatggttatgtctgttacggcctgtggaagcaataactccaatacacagtcttcaacaggcgccagccagaactcatcctcagcagccacttccaccagtacctcatcccaggaaaccacagggatggagacctcttccatggaaacggaaggggacggcatcattgacggacttatgaatgatgtggaaaagggcgcaaatgacgttaagaacggcgtggatgatatcacaggcgaatccaacacagtcaatgagagcggcaccaacaatacaacagaggccagatagcggattgctgtcaggagcctggatatggaccctttctatgccggggacggctggagagggtctatctgcgtaaaaaccagaagatgcctcttgaagagcgccctgttaaggattataatcagttcatggacaaacggggaaggagattgattggggtacataagcagatatggccgcaggaacacgatgctgagacagatgcgaaagaagtcagtgaaatcctggagggagcgctgtccgtctgtcaggcgcaggaaaggccgtgtaagattcgccctgttcctgttggcggccggtattacggcctgggcaggaacaggccggttcattgtcaggtgggccagagagcagataccgcacctggaacggattgaggagagcagtccggtccgggcggctgacgggaatgggcccgcagcggtgaagcgcggtcttaccatccgtctggatgaaaagaaaattcatatattccaggtggaggaagggtatgagggcctttatgaggacggaggccaagggagtgattagcggggcaaaggacattcattaggaattttaatgattgccatgcttgtattcaaagacattgtgtattataatttcttctgaaatggtattcttttatagcgtcagcttataaatctatatcgcaaccatacgaatataagaaaaggacaggtggatacccatggaaaagaaagagatgctctacgaaggaaaggctaagaaggtttacacaacggaggacccggacgtgttaatcgtgtcctacaaggatgatgcaactgcattcaacggtctgaaaaagggaaccattgttggaaagggcgccatcaacaaccgtatgaccaactttattttcaagaagctggaggagaagggggtacctacccacctggtagaagaattaaatgacagggagacagctgtgaagaaggtggagattgttccgctggaggtcatcatccgcaattactccgcaggcagctttgccaagaagatgggaatggaggaaggcatcaggttcaaatgcccgaccctggaattcagctataagaacgatgacctgggcgacccgttcatcaacagctattacgccctggccctgggacttgctacccaggaggagattgacgatatcacagagtatgcatttaaggtgaacgaagtgctccaggaatactttgacggactcaacattgacctgattgatttcaagattgagtttggccgttatcacggcaaggtgattctggctgatgagatttctcctgatacctgccgtctctgggacaaggatacccacgagaaactggataaggacagattcagaagagacctgggcaatgtagaggacgcatacgaagaagtattccgcagactgggtatccagtaggccggaccgggaggtctgacgcggacaaattaagatacaacgcctgggcatgattacccaggcgttcccttctttgagaagggaacagatgcagcgctgttatttttgcagcgcggtatggaactggcagcctgacacacagaaaggacatgacttcatgaatcagaacctgatggattttgatattggggcagataaactgcgtgaggagtgcggggttttcgggatgtatgattttgacgggaacgatgtggcccaggccatatattacggtctttttgccctgcagcaccggggacaggaaagctgcggtatagcggtgagcgacacagagggacccaaggggaaggtagcggcccataaggggatgggcctttgcaacgaggtattcacgccggaggtactggaaggattaaggggcaatatcggagttggacatgtgcggtattccacggccggcagcagtacaagggaaaatgcacagcctctggtgctcaactatgtaaaaggaaccctgggcctggcccataacgggaacctggtcaatgcgccgcagctgcgccatgagctggagtacaccggggccattttccagaccaccatagactcggaggtcattgcctaccatattgccagggccaggataaacacccgcaatgtggagagcgcggtggccgcagccatgaaaaagctgaggggagcctattccctggtaatcatgagtccccgcaagctgattggagcaagggacccctttgggttcaagcccctgtgtatcgggaaacgggataacgcctacatcctggcgtcagagacatgcgccctggaaaccataggggctgagtttgtccgggatgtggagccgggagaaattgtgaccatcacggcggacggcattgcatccaataaggaaatgtgcctgccggacccttccggtgaagccagatgtatctttgagtatatttattttgccagaccggacagtgtttttgacggtgtcagcgtttacagggccagggttcaggccggccggttcctggcaatggattccccggcggaggcggacctggtggtgggcgtgcctgaatcaggcaacgcggcggccctgggctacgccatggaatccgggattccctttggaaccgcctttgtaaagaattcctatgtgggaaggacgtttatcaagccaaagcagagcagcagggagtctgccgtgcgtatcaagctcaacgtgttaaaggaagcagtggccggaaaaagggttatcatgattgacgactccattgtccggggaaccaccagcgccctgattgtgaagatgctgcgggacgcaggcgccagtgaggttcatgtgagaatcagcgctccgccctttctgcatccctgttattttggaaccgatattccgtcggaggaccagctcattgcccatggaagaacggtggaccaggtgagggaaattatcggggcggacagcctttccttcctgaggcaggagcggctgccgcagatggcagctgaaaagcccatctgcaccgcatgctttacaggggattaccccatggagccgccctcccaggacatccggggaagctatgagaaataggcggcgggcatttaaaaaaatatgggtatgtgatatgatagaacacatgaaatcaatgaatacggaggatatgacatgagtgaccacgacagatatgtaagccctctttccgagcgctatgccagcagggagatgcagtatatcttttcacctgatatgaagttttgtacctggaggaagctctggattgcgctggctgagacagagaaggagctggggctttccattacggacgagcagattgaggaactgaaggcccatgcagagaaaatcaactacgatgtggctaaggccagggagaaggaagtccgccatgatgtcatgagccatgtctatgcatacggcgtgcagtgccctaaggcaaaaggcattatccatctgggcgccacctcctgctacgtgggagacaatacggatatcatcattatgaccgaagcccttaagctggtgaggaaaaagctgctcaacgtactggcggagctgtccaaattcgctgaaacatacaaggaccttccaacccttgccttcacccacttccagccggcccagcccaccaccgtaggcaagcgcgccaccctgtggatgatggagcttaagctggacctggatgacctggattacctcattggctccatgcgtttgctggggtccaagggaaccacaggcacccaggccagtttcctggagctttttgacggggaccatgagaaatgccgccgcctggatgcaagaattgcagaaaaaatgggatttgacggctgttacccggtatccggccagacctattcccgcaaggtggacagccgtgtcataagcgtgctggcaggcattgcccagagcgcgcacaagttctccaatgacatccgcctcctccagcatctgaaggaagtggaggagccatttgagaaaaagcagattggttcatccgccatggcctataagcggaaccccatgcgcagcgagcgcattgcctccctggctgactatgtgatgagcgacatgatgaaccccatgctggtggcatccacccagtggtttgagagaaccctggacgactctgcaaacaagaggctgtcagtgccggaaggcttcctggcagtggacggcatcctggatttgtacctgaacgtggtggacggcctggtggtatatcccagggtcattgaaaagcacctgatggccgagcttcccttcatggccacagagaacattatgatggacgctgtgaaggccggcggagaccgtcaggagctccatgagcggattcgggagctgtccatggaggccggaaagaacgtgaaggaaaaagggctggacaacaaccttctggagctgatagcagcggacccggcttttaatctttccctggacgaactgaaaaagaccatggagccttcgcgttatgtgggccgtgcgccgaagcaggtggaagagttcctggaggaggtcattcaaccggtgcttgaggaaaatgcggcagtgctgggactgacggctgagattaatgtctgatatatatcaggagcaataataggaacactttgtccccgcttacatatgatgtattaaaatcataataagcgaggtgaggaaacgtggcccttataaataagcttgataataccgccagtgtgacatatgccggtaatcctgtcaacagcaacgctgtatcaacggttttgcttcttgccccaacgctgcttaaagcggtagacaagcttaccgccagtattggcgataccttaacctatacgattacagtaacgaatgtgggactgagcgctttgacaaacttgccgttcacagatacaattccggcgggcgctgcatttgtgacaggttcttttaccgttaatggcgccgccgcaacaccaacggttaccagcaatacgctgcacatatcatgagcctgttattttcctggtctgtcttttcaggtatgaaagcagctgttttgtaacatggtccggccgtgatatattcagtaattcggcacgcgtaggttcatatagtatgtttgactgctctccatagatattatatttatggggagcaaattaatttgggaagcttgccgtcattatttcagtttcacaatccctctgttttatgctatgatatccataacagttaattctggacatgttatctttcgataaggagaacttatggatgaatgtgaactttgagtactataaagtattttaccacgtatgcgcccacggcagccttacagccgccgcccaggagctgtgtatctcccagccggctgtgagccaggccgtgcggcagctggaaaaggaggccggtacaaagctttttttccgtacttccaagggagtgcagctgacccgggaaggggagcttttgtaccactatgtgaagcctggggtggaggagcttctggaaggcgggaagatgctggagcggatgctgaatatggatgtgggggaggtccggattggcgccagcgatatgacgctgcagttttaccttcttccttatctggaacagtttcaccgggagtatccaaagattaaggtgaatgtgaccaatgcgcccacccctgagactattaaaagcctggaagagggaagaattgattttggggtggtgaccacgccctttaccagcaggggaacggttaagcagtttcaggtaaaggccatacgcaatgtctttattgcaggcagcagcttccgggaattggatgggcgggagctggagtataaggagctggaggcatttccctgcatagcgctggaaaaaaatacaagcaccagaacctttatggacgcctttctggcacagcagggaacgctgctcaaaccggaatttgagctggctatcagcgacatgatagtacagttcgccagacgcaacatgggaatcggctgtgtcatggaagggtttgctgaagctgccatagacaggggagaggtgttccgccttaggtttaaaaaggagatgccgccccgtcatatatgcgtggttacaggggagtccagcctgatttccatgccgggccgcaggctgctggacatgatggcctgcggacgggcggcagctgagcatgatggcctgcggacgggcggcagctgagcatggggcaggcagcagatagtgtacaagggtcctccttggaaatgacataagtattgcttatggaaaacataataaataacgtctttacttatggtataggttgtagtaaattaggtaaggataagatacacaggaatgcgtgtccatcctttcatgaactgcaaatgagcattggacgggaaatacccgaaggaggattttagtatggtcagagcaattgtaggtgctaactggggtgacgaaggaaagggtaagattacggatatgcttgccaaggagtctgacattatcatccgtttccagggcggaagtaatgcaggccataccatcatcaatgattacggcaagtttgcccttcatcttctgccatccggcgtgttttaccagcatactaccagcatcatcggcaatggagtagcccttaatatcccatatctggttcaggaaatcgaagcgctggtggagcggggcgtgcccaagcccagaatcctggtttcagacagggcccagattctcatgccgtatcatgtgctgtttgacacctacgaggaagcgcgtctggccggaaagtcctttggttccaccaaatcaggcattgctcccttttattcggataagtatgccaagattggtttccaggtcagcgagctctttgaccaggagctgctgagggaaaaggcatacagggtatgtgaactgaaaaacgtgattctggagcacctgtaccataaacctcttttggaccccgaggaaatcataaaagagctcctgggctaccgggatatgattgagccgtatgtatgtgatacctccgcttatctccatgaggccattaaggaaggcaggaacatcctgttagaggggcagctgggctcccttaaggacccggaccacggtatttacccaatggtcacctcctcctccacactggctgcctacggagccatcggcgcaggcattcctccttatgagattaaggatatcaccacggtggtcaaggcgtattccagcgcagttggcgccggcgcctttgtcagcgagatatttggaaacgaggcagatgagctgagaaaccggggaggcgacggcggagagtacggcgccaccacaggaagacccagacgtgtgggctggttcgatgcagtggctaccagatacggctgccggattcagggcaccacggaagtggcatttactgtgctggatgtgctgggctatctggatgaaataccggtctgcgtcggatatgagattgacggacaggttaccagggaattccccaccacggctaagcttgagaaggccaggccggttcttaccagactgccgggctggaagtgtgatatccgcggcattaggaagtatgaggaccttccggagaactgccgcaaatacattgagtttgtggagaaggaaattgaggctcctatctcaatggtgtccaacggaccgggaagagacgacatcattatgcgcaaataaatatggaacgattgaaaacaggacccttcggcagctgccggcgggtcctgttttggtgctttattctgtaaacagcctcctacatgggcggattctcagtcagcagctggtggagaaaggtgttgatgacagccagctcctcctccgtatatccgcagagcagggaagccacggtatcagaccagtcctggtccagcttcttgtggaaggcataggccttcatgccctcctcgctgaggctcaggacaatttccctctggttcatgctggagcggtgcttttccagcaggcccagcttcacaaggcgcgccacctgaagggatacggtggagatgttggagtcagtggactgggcaatgagtttcaggttgcacctgggattgtcgccaatcaaattgatgatggacatctggtccacccggagcatcttatcggtaccgtaggtacggaagtctttgccgtattcgtacatctgacggttatatttcatgattaatgatatggtttcctggattcgattctttttttccataattcccccggttatttgatgataaaactgtactcttattagtataaggaaaaacaggaaagatttcaacccaatttcattacatattcataggatggcctgtgtacatgggctgatggccatgcagttgtcatgtttcaatgagaagaggaaggaaaaaaacgcggcggaaatcaggatatatacaacatgactgatatgcggatgggacggatgggagactgatgtaaatttgcataaaaaaatgttgaaatatagcgaaacttatagtatacttctaattgtaaatagtttaatggttaaacagttttaatattaaagtgttttgccaggggagagctgtttggccgtatatcattatgaatcacaggagggaagcgtatgttagtaacatcaggattaagtttcgtagcagcattattggcaattaacgcatttgtgttctggattgtaaagaagtatcccttaaagatttataagtatctgccgccggtcatcattgtcttcctgattgttgtatgctgcaatacctttggcatttggtctttcagcaataaggccatcagttcaatgagaagcaatatcctggaatacatggttcccttcatggtattctgtatcgcggtgcaatgtgattttaagaaaatggtaaagataggccccaagctgctggctgtatttctgtgtaccaccctgagcatctgcgtgggaatggtggtggtgtataagtgttttgcaggtcctctgggactgcagcagattccccagtccttcggcacgtggacagccagttttacggggggcattgaaaacctgtacgcggttgcaggggcagtggggctcagcgatgagaatctggccaatgtactgctgctgattaacctgatattccgtccctggatgaccatattgattgtcatggttccctttgctgccaggtttaataaatggacaggcggcaatccggaggaaatcgatgtgattgcatccagactggatgagactaagagggagaaacagattccaacctccctggatttgtttatgattctgggagtgggccttgtgattgttgcatttggtttccacatgggcggttttttaggggaactggtgccggccgtgcctgcacaggtgtggctgtatctcctggtcacagccattggcgtcatcatcggaaccaccacggaattcggctacataaacggtctggagctgatagggggaacgctggctgtctttgccctttccgtatcatcctccaatgtggacttaaagagctttgccaatgcaggcatcttcttcctgtcaggcattaccgtactcctgattcatgtcgttatcatgttcctggtggcaaagcttatgaaggtggatttgtgtaccctgggaattgccagcatcgccaacatcggcggcgtgtcctcggctcccgtggttgcggctgcctatggtaaatcctatcagtccatttccgtgattatggcggccattggctccatgattggaacctttgtgggtctggggatgtgcaacctgctgattatgttggggtagacaggggaggctttctgagagtatgatagggtacatcagacaggatgcacccagcgggcgtgcatccaattaatgataagtatctaagaaaggttggtaagaaaacatgtacaattttgacaaggcatttgacagacacaatacggaggtgattaagtgggaccggctggagaaggatttcggccggaaggacctgattccctttggaatcgcagatatggactttgaaaccctgccggaaatcacacgggccctgacagacagggcggagcatcccacctatgggtacaccttcccgtcggaggggtactatgaaagcttcattgaatggaacaggacccgcaataactttgacataaaaaaggaggagctgattaccattcccggcgttgtctgcgcctgttccttcatcatctatgccctgacggataagggggacagggtaatggtgagcacgccggtttacgacccctttttcaaggtgattgagcagcaggagagaaccctggtcgcttcctccctgaaacttgcagacgggcggtatgaaatggactttgaggacatggaggagaagtttaaggagggcgtaaagcttttcatactctgcagcccccataatccggtgggacgtgtgtggaccatggaggagctgaccagactcaatgaattgtgcagccgctaccaggtcctggtgttttcggacgagatacactccgacctgattttcccgggtcataagcacataccttaccagacggtgaaccgggatgcggcaggacgcagcgtaattgccatggctcccagcaagacctttaacattgccggtctaaaatcatctatcctgattatcaagaatccggagctgtacaaccgggtgaacaaggcagttactgcgtttcatgtgggcgtggacttgtttgggcttaaggcatttgaggtggcctaccgccacggggcagcctatgtggatgagctgaatcagtatttatatgagaatgcgcagtttgtgacggagtatgtaaaggaaaaccttcctaaggcaaagacgtatgtgcaggacggaacctatcttatgtggctggatttcacagcttacggattaagccaggaggaacttatggaaaaggtggtgggagccggtgtggcgccgaatgacggttcccattacggaagggaaggaaacggatttatccgtatcaatatcggtacgcagagggctatggtaaaggaaggccttgaaaggctgaaaaccatatttggctgattctgtgccggaagaactgagagaggaagtgtgataggatgcaggaattactgaatgaggcccaggactacaggagcagaatggtggagtggagaagaaagatacattcctgtcctgaaaccggattttatctgccaaagacatcagccatggtggcaggactgctggaggagtttggataccaggtacagaccggatttgcggagagtgctgtgctgggaatcctggacacgggcaggccgggaaataccatagcggtcagggcggacatggacgcactgggaatgcaggatgagaaggatgtgccttaccgctccgccagggacggggtatgccatgcctgcggccatgatgtacatacagcccttttgctgggactggcatcctatctttcagagcacagggaccagattccgggcgggtgcgtcaagctgatattccagcctgccgaggaaggcccggctcccggcggcgcaaagctcatcgtggattccggcgttctggatggcgtggacgccatatttggagcccactgccagcctcagtacccggccggggtcatggggtgcagatacgggaacttttttgccagcggcgatttttttgaggtaaagctgaagggaaggggatgtcacgctgcgtcgccccataagggaaatgacctgatacccattgccatggagatgattcaggccattcagaatatacgttccagggagataccgcccatgaagacggctgttatttcggtatgctccataaacgccggggtcctgtccactaaaaatgtcctgccctcggagctgacctttggagggaccttccgggcccacgacagccaggtcagggactatattgcaaaacggctggagcagattgtaagggatatcagccggatgaacggaatcacctgtgaatttgaggattcctttgcatttccctcctttgccaatgacagggatgtgacggatataatctgcaaatccgcggcagaagtgctgggcgaagacaaggtgatgaagcgtacggagcctgagatggggtcagaggattttgcctggtataccaaaaaatttaagggcgcttttttcttcttcggagtgaagaatgaggagaagggcctgacagccagtctgcataatcccggatttgacattgatgaggatgccatggttccggccctggctgtctatatcagcacactataccatctgttagaaaggcaggattcatgagtacaaaggataatacggcaggagaactgaaaaacaggtccatggtgctgtgggcagtgctgagcctttccatggccaatgcgctggtgggaaccggcatatcgcctgcccttggagtcatacgccagacctttccggatgcccccggcgtgctggtacagatgattgtatccctgccgtcactgatggtgattgcagcagccattccctttacctggctcagcagacggtattcggtccggaagctctgcggaacagggctggtcctgttcctggcgggcggtcttttgggcggtctggccaccggtatttacacactggtccttacaagaatcctcattggagccggatatgggctgatgatgccgctgtcagtggggctgctgtcctatttttttaccagggaggaacagcaccgcttaaatggaggaattgtcatatggtccagcgtgtcgtccattatctgtatggtgctggccgggtatctggctgccatttcctggagagccgtgttcctggtgtatctgtttggaatcccatgtctgtggctgtgcctgaagcatattcccgatgtgacggctgcggggaatgaggctgcagggaatgagaatggggttccagcaggggccgggcatcatagctttggaacccttggcgtcattaagaagatatgggtctatggaattggcacgtttgtggtgtttgtaggttattttgccatactgaacaactgctccgccatcattctttcggagggtttaatcagcggggaaaaagtgggaatcattatgtcattccagaccgtaagctcccttgtgacagggctttgtatcggaaagctgaaaaatatcctgggaagatatatgagtaccttcatctggctgtgcgccattggcggacttctttctctgtatgcaaagaacagcctggcacttaccatactgggtctggtactgtttggaatagcccttgcttcggccgtgggcacctttaacgcagaggcatgtattgcctgtgagaaggaggagtccctggcagccggttccgtcattatgtttatgagaagtctgggacagttttcttcaccgctggtattggggttcatggcccgggccgcaggcgtcctggatatacggttcccctatgagggcgcggccctgatgtctgtggttatgctgggcgtgttctgggtaaaggggctgtcaagttaaaacactcctcctgtggaagacatatcaataaaaagtctttcacagggggagtgtcttttatttggttctcttggattctctcaaatcatcctttgaatccatgtctgttttatcctgcaggggattccctccggcatgtccgtccatatcttcaaaggggtcggatggtttcagcaccctggtcataagccccatggcatacatgataatgggtatgaaaaccagggagaagataaccgccatgagataattcttcggcgctcccatggcagccagcacaatggccaggataaacaggccggccagcccaatggcgcctatgagggcaaatatacgtttcagtttcatgtagcagctcctttctgcggcatcaggcctcctcggctaattcttcccagtgcaggtacagcgtttccagctgtccggctatttcctctttttccttattcagctccataagccgcggcacatcggtgtagacctcttccttggtgagcagggcgtcaatctcactgtcccttgtctccagggcatggatggaatcctctgttttcctgagctcgctctgaatcctgcgtatacgggcctgttcttccttctgggccttccactccagcttcaggtcattctgggagccctgggaagggctgccggcggaccgggaggtacgggaggcggatgatgaacggctgttcctggccgcaaaggccgcttccacagcctcctttttctccagatagtagtcatagctgccgatgtaattaatcagggactggccggtcaaatccaggattcgggtggctgtgcggttgatgaaataccggtcgtgggacacatagaggacggttccggtgtaacggcacagggcgctttccaggatttccttggacgtgatgtccagatggttggtgggctcgtccagcagcaggaaattggcgtcggacagcatcagcttggccagggagacacggccccgctcgccgccgctcaggtcgcggattagcttgaacacatcatcccccgtaaagagaaaggaggccagggtattgcgaatctgggtattgttcatggcgggataggtgtcctggatttcgtcaaacagggtcttatccatatgaaggacctggtgttcctggtcgtagtagccgatatggaccttggaacccaggcgtatttcgccggtatcagccggaagcagatggttgatgattttaaggagggtggtcttgcctgttccgttgttgccgatgatggccacccgctccccccgcttgatttcaaagtccacatccgtgaacagggtctggctgtcaaaggatttgctcaggccggtgaccgtaagcacatccttgccgctttccacatccggctccagccggatgtccatggagtcgtcgatgtccatgggcttttccagccggtcaatcttatccagcatcttttcacggctctcggccctgcgtatggatttctcacggttaaaggatttcagcttggcaattaccgcctcctggtgcttgatttcctgctgctgatttaagtatgcccggattctggcatcccgaagcatggcctttttgtcgctgtatgcagtgtagttgccgctgaatacggttccggttccattgtccagctccacgattttagtcaccacccggtccaggaaataccggtcatgggcaacaatgattacactgccgctgtaggtcttaaggtaagtctccagccaggcaatggattccatgtccaggtggttggttggctcgtccagaagcaggatatccggcctggtcagaagaagcttgcccagggacacgcgggtcttctgcccgccggaaagggtattgatgggctttgtgaattcttcctcggcaaagcccagtccctttaatacaccggtgatttcactgcggcaggcatagccgccttccagctcaaactggtgggtcaggcggctgtattcctccagcatggcttccaggcgttcgccggacgcgcttttcatatccagttccagggagcggatgcgttcttccatctgcagaatggggcgtttgacctccagcagggcgtcctggatggtgctgccgctgtccaggtcctggtgctgggccagatagcccacagaggcgcccttgcccagggcaacgcacccctcgtcaggggccagctccccgatgacgattttcaggagggtggacttgccggcgccgttaattcccacgatggccgccttctcatggtcctccaggtggaaggaaacctgctttaatatatgtttctccccaaaagatttgcttatattgctgcatgataaaatcatggtaaactcctttaaaaacgacatattttgctctcacaagtataatataagggaacgattttttcaagaacatatgtaaacgtgtttgacatttttttgacgtgtgtttataatagtactattagagttttgatagaattgcacaatgggaaggtggatacatcatggaacgcaaggagatttcgaaggcagtgatttctaggctgccccgctattaccgttatttaggtgaattaatagaggaaggtgtggagcgtatatcctccaacgagctgagcgccagaatgaaggtgactgcatcgcaaatccgtcaggatttgaataatttcggcggattcggacagcagggatatggttataatgtaaagtacctctattcggaaatcgctaagatactgggaattgacagacagcataatgtaattatcatcggagcaggaaacctgggacaggccattgccaactacacgaattttgagcgcaggggctttgtcatcaggggaatgtttgatattaaccccaaactgattggacttgttatcaggggaattgagattcgctccgtggatgatttggagacatttatccgggagaatgagattcagattgcagcgctgaccattcccaagacaaaggcgccggagatagcggaccgccttgtgaatgcgggaatcagggctatctggaactttgcccatacggatttggtggtgccggaggatgtggtggttgaaaatgtacatctgtccgagagcctgatgcgcctttcctaccgggtcagcagtatgtatgaccagcaggaggagcagagaaattcattaaagtaaatgtttaggaagtcagcgccatgatacttggagttggaacggatttaattgaaatcagccgcatggaaaaagcctgtaaaaaggattattttgtgatgcgcacatttacagatatggaaagccggcaagcaaaggggtccgcctctaagctggccggctcttttgctgtgaaagaagctgtggccaaggctttgggaacgggattccgcacctttatgcccattgacgtggaggtgctcagggacgatttgggcaagccctatgtccgcctttaccggggggcccttacgcggtttaaggagatggggatggaacgcctggaggtttccatcaccaacacaggggaatacgccatggcatttgcagtgggagagggaaggataaaggaggtacagtcatatgaggatgctggtaacgggaaaacagatgaaggccattgacgcatataccatccataccgtgggaatcccatccctggtcctgatggaacgggctgctcttgaggtggcccgggcagcagagcgcctttgggagaagggggatacggtgtgggctgtatgcggcaccggcaacaacggggccgacggcgtggcggcagccagaatgcttcatttaaaagggtatccggtgcgtgtattcctggtggggaatccggaaagaggaacagaggaattcagagcacagctttccattgccgctaatgtgggccttttctcttcgccctggcaggacggggaaaaggaaacgtgcggccttctcattgacgcggtgttcggcgtgggactgagcaggccggttgagggagagtacaggcagtgcatcgagatgctggaggccaggtccatacgccgtaccgtggcagtggatgttccttcgggcatccatggggatacgggaattgtcatgggcattgccctgaaggcggatgtaaccgttacctttggatgggagaagaccgggacagccctgtatccgggacgggaatatgcagggcaggtggaagtggctgatatcggatttcccgttcaggccctggaggcggtgaaggcggcagagggaacggcggcaggggattttgccgttacctacggggatgaggacttgaaacggattcccaggcgtcctgcttattccaacaagggaacctttggaaaggtactgattgtggcgggctccaggaatatgtgcggggccgcttacctgagcgccttatctgcataccggacaggggccgggctggtaaagctccttacggtggaggaaaaccggcagatactccaggaacgcctgccggaggccattatagccgcctacaccccggaccagctcatggagggcagggaggaattccggaagatgatagaagcccagatggaatgggccgacgtggtggtcctgggaccgggactgggaaacggaccctacgtggagtatctggtggaggatatactgaccagcgcctttgtgccggtcatcattgacgcggacggcctgaatgccatagctggccatccctatctgacatcctattatacggagaacattattgtgaccccgcacctgggggaaatggcccggctcacgggggagggcatagagcagattaaggaaaacctggcaggcacggccctggagtatgcaggccgctacggccttacctgtgtgctgaaggacgcagccacggtcacggcagggcgggacgggaatttgtacatcaactccagcggcaacagcgccatggcaaaggccggctcaggagacgtgctcacaggtatcatagcaggactgatagccattggcatggaggaggaggaggccgcctgcctgggcgtatacctgcacgggcgggcgggagacgcggccgcctctaaaagcggcgcccacagcctgctggcatcggaactggcggatgcggtcggcagtgtgatggccgggtctatgaattaaaatacaatcaagagggtccccgtgaaaagggggacatgacacaggaggcaacaaccatgaattcttacagcagagtttacgcagccattgacctggatgcggtggaatccaatatgagggcaatgaaggccagccttgggccagccacttccatgattggtgtggtaaagacagacgggtacggacacggggccgttccggtggccggaaccattgccccttatgtggaaggctatgcggtggcgaccattgacgaggcaatcaatctgcgccgccacggcatacagaaaatgattctggtgctgggcgtgacccatgagagccgctttgaagatttggtccggtatgatatacgtccggccatgttccggtatgaggaggccaggaagctatcggagacagctgtaaagaacggcgccagggccagcatccatctggccgtggacacaggcatgagccggattggcatgacgccggacgaggcatcggcagaggaggcagtcaggatatccgggcttgcgggtatccgcattgagggaatgtttacccattttgccagggctgacgaggcggataagacgttttatgaggcacagtacagggcatacagggatttttgcgaaatgctccgcagccggggcctggatataccggtccgccactgctccaacagcgccggcattgtggaggggctggactccaacggactggatatggtgcgggccgggatttccatttacggtctgtatccttctgatgaggtggctcaggacagggtaaagctggttccggccatggagcttaagagctttatcacatacataaagaccattgagcccggtacggccgtgagctacggaggcacctttgtggcagaccgtcccatgcgggtggccaccattccggtgggatacggggacggttatccgcgcagtctctccaataagggcacggtgctgattagggggaaacgggcaaaaatccttggaagaatatgcatggaccagtttatggcggatgtaacggacattccggaggcagcggaaggggaccaggccaccctcattggaagggatggggatgaatgcatcacggtggaggagctggcccgtctgggcggcggtttccactacgaaatcatctgcggaatcggaaaacgggtccccagggtctatctgagggacgggaaggccattggccaaaaggattattttaacgatatttaccagggcttcggatatatgtaaaagcctaccaggctcaaagagaacgtctgaatcatatgttattagtgtggcgtaaagcaggccggatgccccagtgtatccgggccatgtatacacaggccaaaaatgtcaatactaaggttgaataaattgacggagtgtgaacaatgtgattatcagacgcggagatatttattatgcagatttacggccggtggttggctcggagcaggggggagtgcgccctgtgctgattatccagaatgacgtgggaaataagcacagtcccacggtcatatgcgcggccattacatccaggatgaacaaagccaagctgcccacccatgtggagctgcccaccaggcgctgtgccatgattaaggattcggtcattctcctggaacagctgcgcaccattgacaaacagagattaaaggagaaaatctgtcatattgatgaggagctgcagcagagggtggatgaggcccttatgattagcctggaactgcgtacataagcaggcgggggcaccatgggcaggtgtataaggcaccattgacgaaatatgagaaaaatgatatgataagcagagttatgccgtattttaggggtatagctctgctttttttggcagtactccgcggcaatggcgttttatgagtatgaaaggagtctttttgtcattatggacgatggttatccacctgtcagtatcctcatattgataggatttattcttctggaggcagtgttttacggttttggttcggcaatacagaatgtgaacgaggggaagctggaagaggaggcggccggggggaataaaaaggctgcccgcctgctggagatggtgaaccgtccggtgaggtttgtccataccattcaggttaccacccatctgatgggtatgattataggagcggcaatcctgcctgccatgattggcatggtggagcgcaggttccttctgggaaaagtgctggcctgggtggacccggcccaggtgatggagatggcaggcacgccgtggtacaggaacccatcctggtggcagtgggcaggacttctggccctggtcaccatatttgtcctggtgctggtcatcagtttcggcatcattatacccaaacgcctggcggccaaggagcctgagaagtggggataccatatgcttccggtggtgcttttctttgctggggtattcctgcccctgacacgcctgataacgttgatttcagccctggtgctaaagccctttggggtggacctggcggacgacgacggcaatgtgacggaggaggacatcatgtccatggtcaatgagggccatgaacagggcgtcctggaagcggacgagacggagatgataaccaatatctttgagctgggagacaaggaagcagcggacatcatgacccaccgcaccaacatgactgccctggacggcagcatgagccttaaggaggcagtggatttcattctgaatgaaggcgtgaataccaggtatcctgtatacggggaggacatagacgacatcatcggtatcctgcacatgcgcgatgccatgaccttttcagaacaggaagagaacagggacaggctggttatggacatacccggccttctgagggaagccaatttcattccggagacaaggaacatagatacccttttcaaggagatgcagtcccgcaagattcatatggaaatcgtggtggatgagtacggacagacagccggcctccttaccatggaggatatactggaagaaattgtgggcaacatcatggatgaatacgatgaggaagaggatttcatacaggccatggaggatggctcctttgtgatgagcggccttacgccgctggaagacgtgatggagactttggatattgagctgcctgaggaggacagcgatacctacgataccctgaacggatatctggtttcgcggctggaccgcatccctcaggagggggagaatccacaggtggaattcggaggctggctctttgaggtggagcgggccggcaataagatgatagagagcgtccgggtatttcctgtgccggaaggcgggaagactgcggacagcgggaaagattcggtggaagagaagtatgatgcagttagtagagagcacgaaggagatgtttcgtgacagcagatttttaaggaaggcgcttatgattgcctgtcccgtggccctgcagggaatgctcaacacagtggtaaacctggtggataccctgatgattggaaccatgggggccacagccatagcagcagtgggactggccaataaatttttctttgtattttcgctgcttgtattcggcattgtcagcggaagcggcgtactggcggcccagttctggggaaacggtgatattaaaagcataaggaaggtcctggggctttccattctgctggccctggcaggcgccctgtttttcgttgtaccggcccttatgtccccccaatccgtcatgcgcatattcactaccagccatgacagcgtggagctgggggcaaagtacctgaagatagcggttctgacctaccccttcctggccatgaccaatgtatatgtggccatactccgggcggtgaacaaggttatattccctgttataagcagctgtatcgccattgtgattaacatatgcctgaattacgtgctcatattcggcaagttcggcgcgcctgccatgggagtatccggcgctgccgtggctaccctgatagccagaattattgaaattatgctgattctgggatatgtgtacggaaagaagctgcctgtggcctgcggcatcagggagctgtttggctggagcggcctgttcatcggccagtttttcaggacatccgcccctgtcattgccaatgagttcatgtgggggctgggcacaaccatgtactccctggcatacgggcgcatgggggacgaggcagtggctgccatcaccattgccaccaccatacaggacatcctggtggtgctgttccagggtctgagcgcggcaacggccgttatcctgggcaatgaactgggggcaggccatctcaagcgggcggagaagtatgcggtgcatttcttcatcctccagttcattgcaacagtgggcgtggcagtggtgctgattggaatccggtggcccattatcagtctttacaacatcacgcctgaggtggcgcgggacgtaagcctgtgcattctgatttttgcggcctacatgccggcgaagatgtttaattacgtcaatgtggtgggagtgttgagaagcggcggcgacacaaagatgtgcctgttcctggacaccagcggcgtgtggttcatcggcgtgcccctggcgttcctgggagccctggtgtggagactgcctatctatacggtctatgcactggtgatgacggaggaggtctataaggctgtgctgggatatatacggtacaggcagaagaagtggctcaggaatctggcggcggaggtgcggtagctgtgaacggatacagggcgggaatctgagaatccgggccaaagaatttttcttgccatataaaaaaattcgtgttaatatagaaaagatgtgtataaaatacagcagaaggctgtatttgaacgtataaaccataaaagaagaaacaggaaagggtgtttaccaatgtcaggacattcaaagtttgccaacattaaacataagaaagagcgcaacgacgctgccaagggcaaaatcttcactgttataggccgtgagattgctgttgccgtaaaagagggcggggcagacccggccaacaacagtaagctgagagacgttattgccaaggcaaaagccaacaacatgccgaatgataccattgaccgcggcatcaagaaggctgcaggcgatgccaactccgtgaattacgagacccttacatacgagggatacggccctaacggcgtggccattatcgtagatacgctgaccgacaacaagaaccgcacggctgccaatgtgagaagcgcctttaccaagggcggcggcaacgtaggcacgccgggaagcgtgtcctatatgttcgataaaaagggacagattatcatcgacaaggaagagtgcgacatggacccggacgaactgatgatgcttgccctggatgcaggcgcagaggactttgccgaggaggaggacagctacgaggttatcactgcaccggatgatttcagtgctgtgcgcgaggcgctggaggcccggaacattcccatgatggaggcggatgtgaccatgataccccagacatgggtggagctgaccgatgaggacgacatcaagaagataaaccgtacactggatttgctggatgaggacgacgatgttcaggccgtgtaccataactgggatgagtgatcaaaatagatgacataaccgcaaagccagtaaaatcaaggcttccggcggtttttgagggcgattttcaaagccccaaaaaatccaattttatagatgacatagcgtttttggagtcaaaaaacgattttgaggcagtgagatgaaaaaaatctcactgccttttttcatttctgaaaatcgacaaaaaagtggtttgcaaaaatataaccattttttgaaagaaatttgaagtttgtgaaaaagagataaagtttattttgaaagaaactgtatctttgttgatacagttcgaaatatattttttaaaagagaggaggaattcagatataacaaaaaaataaatttattttgtgaaaaccaactaaattaagtaaccttcaaaaaatgaaaagaggaatgaaaatgaaggaaaaagaaatcaaagtactaagagtaaagccgcatgaacatcctgaagtctatatgctgaaaaatacattggaagcaatgcaggaagcagtaggaggatatattgacatcgtaggattagatgacaatgtatgcatcctattaaatgatgagggaaaattgataggcttggaaggtaacaggagaatcggcagcgatatcatcgttggcgatttttttgtttgcggcagtgacgaggaaggaaacctgacatcattgagtgaggaggcgttggacacatacacaaaaattttttatgaaccacaggagtttacaaaagaagaaatagaagaaacgacagtaattgaattttacacatttgaataaggaggatgtacagttatgaaaaatatgaagacagaaccaagtgaaaaaacaattatttacagaactccaggtgatcctattgaaatcacagatgaaatgctggagaatgcagagatcaatcctaatgaattggtagatatcattcttcaaaagggatgcatcattataaagccaacaagtgtgcttggcagattaccagaggatctgcttttgctttatgaagaacttggattttcgagagaaatggtggagtgtgtttttacaaaatatgctgaagaagcaggaggattcgatgctttggttgaacaaatcaaaaaagaaaaaaatgtggcattgtggtaaggtgagaaaatgcgaaaaataacagacttaagaggaatcaaagataccgccaaagtattcctgcacatgaatatagaaaaaacaaagttttcgccgttggtcatcaagcatccgtttacagattcagcgatggtttgtctgtcgcagactgacggcgaaattgcttttgccaatattatggaagacacaaaggcatttaccctatggaaagaacaagtggaaaagcagattgatactgcggaagatgtgtttggggtatatcacctcatgacaaaatcttatctgcttgcttttttaaaatatacggaatcatacttgtccagagaggatttttccaaaatgcttgcagacatctggattcggacagaagcacctaatcttgatcccaacttcaagcagaaagaactgctggatctgttccgtgattcaaaacaggaggagatgatgacagaagatgaaatagaaacactgcgaagcctgccggaaacagtatcggtttatcgaggcgtgacttcatataatgcaggcaaggtcaaagccttgtcttggacactggatcaaaaggttgcccaatggtttgccaatcgatttggagaaaacggtactgtttatgaggcggaaatttcaaaggaacatattttagcgttatttaaaggaagaaatgagtgggaggtgattgtggaaccagatcacttacttcagttatcagaagctatggaagaaaatatggaagaaccacagttataaaaacatgatggcaggaacatgaaacattcatgttctttttttgtgccagaaaggagcagaaatgaaaagaaagtatccgcagaagaataaacagcgaccggcgaaaaagcttccgccggagagcagagtccagcctcataaaaaagtaaagtatcacaggcgatctgatcagatttacgggaggtaatccatatggaaaaagcatcccataaagccaatgtgcagtgtgccgaagacatcggaaaagccatcaacagttatttcgatggttttcattaccatacaggctttgagaaagaacttattgaaacctatggcatggagcaagtcaaatatgttgttgcttataacatccagcaaaagcttaacgatggaaggatcagcaaagagaataagacctgggcattgcagagccaaatgaaccaaggcgaaggcaaccccaaaccggaatatacgatccatacccacagtggcttgttggatttatttgccaatagtattcgagaacaacagcttatccatgaagccgaagaaaacatgaaagactaactattaaaagtcaagtctaaaataaaagttttggatgaattgcagagcttccagtctacaccatgggttctttctttacaagttagcctctgaacagtaacagataggacaggaatggttcacagtgcggcctgcatctatttactaactcactttaaagtggtataatgtaaatagaaagagggtgagattatgcgcaacattataatcgcttcaaacaaccaggaactgcaccatcttctgtcttcatttttagcacaagccggttactcacatgtctactcatccactgacagcaaggaaaccttctctctgacttatcgctataaccccaagcttatcatcattgatttggaactgccttcgtgtgaattaacagatattttcaaatttctctcaggtcctcagcgcaggattgtgctctttgtggcccctcatcgtgaggtggatgaaactattttgggattgataaaaaagggctatacgcgttttgtcatacatcccattgaccggaagctgtttttaagagaggttgaagaaattatcaatttaaataaatagattctgatacgcctgagaatttgaataaactgggcaggactgattggggctgtaaaaaactccctcaaaagaaaaatcgctgaggccgtgtgacttcagcgattttttgatatacttattatatagaggcaatgggaacagttatagctgggtatgtaaaatcctgtacaaagaaacagggagcatacgcaatagttaacacactttattgcagcattctattaatcgtgatacaattatgccagtactttatctgaacagagtgtgaaatgatttccacacaggaggagagggatggaaaagacaaacgaactttatgagttactgtatgagtattttgaatcccgtattctctttggattttacagatacgatgaacagctgctgtcgttacaacaactccgggatatctttcatatggggcgaaatacggttcagtctgcactggataagcttgaaaaaaacggatacatagaaacgcaggaacggaagattgccagggttgcatacaggggaacaagagaggtattcagagaaaataccgccaagtattttgtgccgcgcaaagaaggaatcctggatttttgctacgcaggtgaattgctatttaatcctatgtgggagatagcgatacataatcctgatgcggacatagtggattatctaaagaaaatccatggagcggaaagcgcaatgatggtagcaatgcccataaagctgtatctggatgtcctgcgtacctttcacaatgatttacttcttaacctttactggcaatgccttcgttaccttaattttctgtatccgagtaaacgtgaaatcagaaccggtaccatagcggaggaagtattatcggtgcgaacaatggatgatttaaagacggagttcgattcctatattgacagcgcacaaaataaagtaattgatttcattgaatccgcacgcggtgagtatcatcttgaggccgttccgcagattccgtttaagtggaatatttatcgcagccgtccccaggtacggtatacactggccactgtggtcatacgtgaaattatatgggagcgttatccggtggggagttatcttccgtccctgcctaacatggcagagcagtaccaggtatcattgagtacggtgcgccgtacggttgcagtgctgaactctctgggtgtcaccaggacctatatggggattggaaccaaagtctgcctggagcccatggatttgaatctcctgaagaaggatgaaatccgggaaaacatgctgctgcatggagaaggattgcagattctggcattgacggtccgcggcgtggctctctttacattggagtcggccacgaaggagaagagggatgaactgctgcaggaaatcagaaaacttcatggaaaaaccagcagtatcctgtgcattgacgttcttttaagcttcatctccagagaatgtccttctgcaatgatacgggaatgctatgataaattaagagaactggctgtatggggatatattttatctgccgtattgatgagtaccggacagctggacaatgatttgtctgattttattgggcggctggaaaaagatttacagtcaggtgatttggcttcgttttccgatgaatggaagttctttattatggacaggttaaattacttttatttgaaatttgcatttctaaaataagtagggattagctttatgatactttactatggtcacaaaatagtatataacagcaatacatacggggaaacttcgcacagtgagtcccctgcttcagctccgcccgggttccggacctgaaacagtggcaaggtaacggtggtggatgcccgcagaatgctctttgacggaggtttttggttactcacatgtctgctcgtacactggcagcaaggaaaccatctctctgacgtatcgctataaccccaagcttattaaacaaatagagtctgatatgcctgaggatttgaatcaactgggcagaactgatagtcacagaggattaccgctttactggtaatcctctgtggctatgttaaggtcatcatattttaggttgtgataatttcagctttgcaagttgagacaaaggtggggtcgctgttatttgatccggccagaaccaaaacaccgaattcatttcgaaggaccgtgccctgtgcaacggtctggcctcctgcgttgatatctacgcctgctgtcccaaccggcaggtaagcgcgtatggcggcctgacagtcagcgtcgcatcctgtgggtgccggggtgggtgccggaagataggtgatggcgttattatattcagcgcttgtgaccctgacagaggcaatcctgcagatggagagtgcttcctggggaacgccctgcgcattggtcagctggaaaagccctgaattagggttggtatcaggcgccggcaaaagcgagcccggccttccgctggcattattgccgctttccatggcaacaattacattatctgttgggtaaagctggattatctgctgtaatatatttctcatctgttgtacacaggcacagcctgcggatagcggagcagggccggttacgccagtcgctccagtggccccggttgcaccagttgacccggttattccggtggctccggtggggccggtcagtccggttacgccggtggctccggttgcaccagtcggtccggttattccggtggctccggttgcaccagtcggcccggttattccggtggctccggttgcaccagtcggtccggttacaccagtggctccggttacaccagtggctccggttgcaccagtgctaccagtcaatccggttgcgccggttagtcccatagggccagtcggtcccacatagccttgcggtcccatggctccggttggccctggaataccctggggcccgggaataccctggggtccgggaatacccctggggccaggaataccctggggtccgggatttccctgagggccgggaatacccctggggccgggatttccctgggggccctgagctccagggcagccccggggacccattggaccaggaacgccagggcagccccgggggcccattggcccggttggaccctgacagcatccgccgcaaaaagagttaagatttgtatttgccggttctgtatatctgccgttgttttcggaataaccgttggaattacatccataagggtaatctccgcagttcataccgtttgcataatcatatctcattcaatatcactccttcacaatttcattgcagactgaatacaattaacctgtctgaatttccattcgcttagacgtttttacatccataacatcatataaaaactaccacataaaatccatttggtaaggacaagggtatcagttaagatattatatgtgggcgtccctgttttagtgtttttggaactatatgaatgggtctgcgggaacagcagtctgtcaaaaagatggtgtttatatcataagtaacgcaaatctaacattctaactgcataaatgtaacggtcatgttacgcctgttatttataatataatcagacagtaacagaaaaaccggcccggcctgtcacataggcggagccggtttttaaacacaggaggaatgtatgaaaaaaccaataaagaagttggctgcatggctgctggtaacaattcttatgctgcaaaataccatgctgacagccaaaggagcagactacggtacagacgaaaccgtcagaacaccgggaatctacagggacggccgatatctgaaggaccaggatacagtgagagaacaggatgtcctggaatgggtcactgaagtaagcttttccggggaatcagaggagatagagataccggaagggctgctttacttttccaaagccaggtcccttatcacattagcaggaccggacggaacagtaagggcaaaaaccagcctgtcagaggaccaaaggatattgactgtggaaaatccggattatgagaagaaagagagacagaaaaagtcagatgagaaattaatgaattctgatatcataaccccgccggataatttatttccatcagacaatatatcaccgacggaaagccaggagccaggaaacgcagaagatgacggcagcagcgaaagtgcctccggcaacagccaggaaaacccaggcaatgaaaactcatccggcaacagccaggaaaacccaggcaacgaaaacacatccggcaacagccaggaaaacccaggcaacgaaaacacatccgacaacagccaggaaaaccccggcaacgaaagcacatccggcaacagccaggaaaaacccggcaacgaaaacacatccgacaacagccaggaaaacccaggcaacgaaaacacatccggcaacagccaggaaaacccaggcaatgaaagctcatccggcggcataatggacaacaatgacagccaaacaatctccggatacagtaactctgcatccattcacacgcatccggcgcttcaagcgtctataagcccccgcggccggcatcttctgacatcagcagagaaggatgctccgctcggcacagattcacaggcagcaaagataaaacaggaagatgatgaaaacatccagaagacagaagaatcagacacatgggaatgggattatatcctgacagtgccctgtaccattgatacggaacaggccgcggaggacggaaccataaatatagaaggattaagtctccgaatcgcaggaaacgatgcggacggaacagccctgaatgaactaaaatcccagctttacaaagaggattcagatggcggagtgggagagaggataacgggaaactatgctgtcagtctgaataccccgttatggcttaaaatgtccatcccatccctgaaggatatggatgccggaacaacatatctgataacgcttccggatgccctttctccggttgacgacggaagtatgtccctggaaaaagttctggacggaatatcatccactacattcggagaagttgtctggacctccggttccaccgtactggaagtgacatttattgacttcgggccaattgctgtcagcggcgggaccataacctataaggatttaagagatgttgaaatctactattcctgtaagctgaaccatgataatctggatacagacgacaagggaatcgtgacaatcagcctgcccggaggcacggaggtatccttcaccatatccgaacgtttaccgcagccccccaaattagaaaaagacggaacatgggatgccgacggaacaatacactggaaaatcacatacacacagccggttaaaggttatatagaggataaccaggattccattccgaaaatcatccgggacaggattccttctgaattggaatatgcggacggaacagcccgggcagcggctcatttaaacacagtatccgtccctcaatatgataaggatacccaaatcctgacctgtgacatcagcagcctgccccccggcgagacagtggaaatcacctatgataccatactgaaagataacactctgtccaatatatgggcaaggccaggcggaggcttaagctttaccaatcaagcggaggccttggatgaaaatggcgtttccgtaaatccttctatacaggccgcaaaaacagttcaggtcccctctgactggccgggacggaacatgatagcaaaacacggcagaaccattgaaccccaagcagatggtgaccagtggaaaatcaactggaccgtaaccgtcaatacagtaagcagggattttgaacacctgtatgtgattgacgaaatgggtaagggactggaactggacaaagacagcattttaataaatggaatcaacgcagatgatatcagtacaatagacaaaataataaccgctgacccggtcagcgcaaagacaatgctggaaatcaagctgatagaaaacagtactcccaaaacagcagaagcagtctatacaataacttataccacggccattgaccaggattattttgaccagaacaaccagaatagccaggctggacagggactgacagcagaggacctgtccaataaagtgagccttgattatgcctggccggacggcagcggtcctggcagcgaccggatgcctccttctgtttccaaaggtcccggcgacctgaacattaataataacctgatacttaaatcagcccgtgcttacgataaatcggcccatacaatcacatggaccgtgaccgtcaatcccaataaagtaaacatgacaagcatacatctgacagatgagctgattacgccgccggctcccggagaatacaggcatgtgtttgttccgggggcttcaacggaagaggttgaggccaacaaagatgattgcctggatgctatctgcgccgccattgaaaaggggcttgaacaggcaggaataaccggcgcaaatccggattgttttaacagaaacaatgtgtcattggactctgtgcagggccagtccggtaatccatcccctgtcctggcactggacctgctggatatcagattaggagacatcggaaaaaacagctttgattttactcttacatcttatgtggatgacccggatttctgggcttccaataaaaatgaaacattccataacacggtaatcatgaaacgggacggcacaaccgtggaaaattctcccatccgtcaggacaggacagcggctgcccagtacgcctgcaccagcaatgtactgaaaaaatcccacatatcctatagtccggacaccagagaactgacctggaagctaacggtcaatgaaaaccaggctccgctgggtgatgttgtcattacggacgacctgcctgaaggtttaagctgtaccgccgataatgtaaaaaacgccatgctggacaataccgttttcccgcagggtgaaaataccgggcaggatacaggcacagacggcggctctcaggctggccaaaaggcggggataaccgttgggccggatgactcaggcagtcccaacaagagaatccttatacggctgaaggatgtaaagcaggcacataccatcaccattcctgttacggttgatataaataatacatatttccgcaatagcagggaagtgtcagtagaaaacagagcagtcctttcagctgcagccaatcccggaaagaccgtggaagctgtttcaaagatggtactggaaaatgagattttaaataaaaaggatatatcccatgcaggaaatacagtaaactaccaggtatcggtcaaccctcttggcgtcagcctgacaggaggatacccggatatggacctgtacgtcaacgacactctggatgcagggctttatattgatttggagtccgtaaaactgtatgaagcccttccgtcccaaagggttacaccggacagcagcggccattacaggaccggactgaccatgggcagtgacgtgacgccgccattggaccaaatatactacaatgcaaaggaaaattcattctctgttccgataccggatgcagagggaagctatatccttacctacagtgcctatgttgtccggtcaggagtcaagttgaacaatgccgtaaaactggtgggaagcataatcccggaggattccggcaacagcgggtccagtgctgcatttacccagaaatcctttggcaccgccggtttttccctgccttcggaaaaattcctgtccatccaaatcaggaaggttgacggagagctgcgtatactgaagggagctgcgttcggtctttattcagaccggagcggggatgcccttctggtgtccgcaccatgtgacgacaacacgggtatctgtacccttgcggtgcccaggagccggattggaaacctggaccggatttattataaagagataaaagctcctgaacattacgccctcaatgaccagtggaatgaaataaaaacagatgagataaaggatgaggtgcttacatttaccaatcttcccagtgaagacggggcagcaggagccattctggtaaaaaaaatggatgcagattcgtccgcggccctgaaagatgcagtattccgtctctataccgaccaaacatgcgccatgcctgccggggaggcatccgtcaccggtgaggatggaacagcagtctttaccggtctttatccgggacggacctactggctgaaggaagaggaggctcctgccggctatgtcaagacggaccgtgtaacggaaaccgttgcggtaaaagaccttccggcagccgtggagatttacaatgaaagagccaaagcagtcctgaccattcttaagacggaccgtaagaccggccttcccttaaaaggtgtaaagctgcagctgttttatgaccctgcgtgcacaatacctgccggagatgtggcggagacagatgaaaatggaatgcatacctttacaggactgcagcccagaaccgcctactacataatggaaatacagccggctgaaggttatctgcctgatttgtctgtgtatagcgctgccacaggtgaaaacacagagacagatgcatccggacatgtggcgatggaaagcagcaggccggagccgcctcccgctccggaggatggggataatccctccgataccccggaaaacaatttacaggattccggccggccccatggttccggttcttccggttctggttcctccggccatacggcgggacagggggccgcgcaaacggattatgcaggacctggccctggcgtacaaacccaggccggacctgccgtgacgccggaacaggaccaggccccagggcatggtcctaacagcgccatgtcagatgatacggacagcagccctgtccccctgcccaggaccggagaaaacaacaataccgtcatgtggcggtgtctggctgctgcatccctgatgggaatgctgtttctgatggctgaccccaagagaaggaattagctttatgatactttactatggtcacaaaatagtatataatagcaataaatatcaggaagttgttgctatatgaatcaatccaggaggcgtcagcaaacgcctcctggattttcgatagcacttcacaaaacggttcagcatgtaccgggcggattttacaggcagccatattaagcgattgcaattacaggctcctggttccggtactgttcaatggcctgttccagcctggccagcattttttccctgtcaccgggcagggttccccgcaccctgaattcaatgcggtcgtggaaaccgtcatattccagcggttcttcggcagtcagcctctccagaagcagccgttcctcctgcaggttttccagttccgtggcaggaacaaaggtttttgcctgggcctcttgatacagaggggcgctgtgaaacagaaaaagtgagaagtttatgatgcgcctgggcttggtgcggttgaagaattctgcggtggcagctgcattttcggccccccttccatggcctgcaattccggtcatgatatgggcatcaaaaatgaatcccgcactttgaatccggtcaatctgacggtatgcctggtccagattgtggtcctttcccatacggcgcaggacgtcgtccagaccgctctcaatgcccaggtacagatgacatacgcctgcagcccggagggcctgcagctcttcctgagatttggcttgtatattggttactgtggcgtccatattgatggcgctgcaatccggaaaataccggtgaatcaggtctgttatcttcagcagacggtctgtgtccagcccaaaggcattgccgtctccgagaaagacgcgcattggattgccgcccaggttccggacccgcgccagctctgcctctatctgctccatgggaagttccctgtatttcaggtgccggaacagagtgcagaatttacaccggttgtaggagcagccaacggcaaccggaagcatataggacgaacgttccatgggaccacggcagatttgtccttcataattcatagaaatccctcctgaaaatcataaaagtatcactgtttttatctgcttttattttaccacgccggaggccggttcacaatccgaaacttggaaacccctgccggaacccttccggagggccaaactggaaacataaggattttcacgttgaagtttatagacattaggggtacaatatgcttatatacatataaatcatacggggtacagataaatgacagctaatatatttcttaaggagcagaagaaaccagaactggcggattacatgaatttcagcgctgacggacgcggaaacctgggcggggatataccggtggcggtttaccgtctgatggaatactccctgaaggaggaactggaagacagatttgggacggaagagcagaaacagattttccgcagtgcaggataccgtgcaggcgtgttttttgttaaaaaccagctggatttatcccaggagctgaacgcattcatagcagcacttcagtcccggcttgcggaattaaagataggcgtcctgcgggtggaacggtttgaggaaaatagcggaaaactcatactgactgtctccgaggatgcagactgctcaggccttcccctgctgggggaagctgtctgcaattacgatgagggatttatatcaggtatcatgtccacatacatgaaacgcaaatactctgcggtggagattgactgctgggcgaccggcgaccgggtatgcagattctgcgtagaaccggaagaataaggaataatgaggcacggaaatggaacatgataattgcgaccaattatttgaatacctgagaagcatcttatatgaccgtcatatccagaccctggatatagaaagcctggatgagccataccgtaaattagggcagggacttaaggttcttcagaaggccgtggaagagcttcttgccttttccgccgatatatcacagggaaatctttcgggtccatgtccttccagggataactttctctgcgtgaacatgaaaaacctgcacgcaaatttaaatcatctgacctggcaggcaaaacaggttgccgcaggggattattcccagcatgtatcctatctgggcgagttttccgaagcattcaacaccatgacggcccagctcaaggaacgggaagcgcttctgaaagaggaggctgaaatcgccagaaaaagggcggcggtcatcgaagagtacaatgagcttctggtggagatgaccaggaaaaggaatgaatggatactggtggtggatgcggacacccgcgatatcacatattgtaacaaacgcaaggatgagatacgaattgaccctgctttctgcgaaatctgcaacaaccgtttctttttccggaacagtattttaaactggcaggacagtgaacagtataagatatgggaaatcggagatgaggaccacggcttttaccgtattaccactttttccatcgaatgggccggccacaacgcctttgcccatattgtggtggacattaccaatgaaaagatgacggaaaacagactggcaagcaaagcatattacgattcaggcacgggaatccgcaaccgtctgttctttgaggaatatatggaggcgcacttaaataagaaatccgacattacattatgttatctggacctggacggcttaaaatttgtcaatgaccaattcggacacaatgaaggtgactgctacatccgcaggtttgtgtctgtcattgaaaattccttccgcagctcagatgtgtttgcccggattggcggggatgaattctgcgtgatactgccgaataacgacagggatgctgtggagcgcaggtttgccgaggtgctggaacaatttgtggctgaaaatgacaaagaataccctgtaagcttcagctacggggtggtacaaatagatggaaccaacagcaatttgaccatggacggcattatcagggaagcagacgccgccatgtatcaatgcaaaaagaacaacaaagaaaaatatcataaagcatgaaggaaaggagcgccatgaagctctgcattgcattatctggaatggttatagtgggattataagaataacaggaggatttcaagtgactattccagagaaaacagtttatccccgcacaggagataaggaaacaatttatttaaaaaatgtaatcacagaccccgccataacagtgggggattacaccatgtataatgattttgtcaatgacccggctttattcgaaaagaacaacgtgctgtaccattaccccatcaaccatgaccggcttgtcataggaaaattttgttccattgcctgtggcgcccggttcctgtttaacagtgcaaaccataccatgggctccctttccacctatccatttcccctgttctttgaagaatggggactggaccggacggatgttgcccaagcatgggataataagggcgatattgtcattggcaatgatgtatggattggctatgaggcagtcatcatggcaggagttaccattggggacggcgccgtcatcggcgccagagcagtggtgacaaaggatgtgcccccatatacgattgtgggcggcgtacctgccaggcctatccggctgcgctttttgcagcagaccgtggatgccctcctggagctggcatggtgggactggcccaaagaacagatagcagcaaacctgcgctggatacagtccggcaggattgatttgctgaaataaaaaagaggggattttcccagaagggagaatccccccttcctgccttaactgtatggggaataatttacattgttatatgtaagaagctgttatataatggatggaatgttatgtccatacataatagatgcaaaggaccgggagaatatccatgaatcgaatgtttagaaactatatggtgtttttggctgtggtgttttgtatgatgctgtcatgcggccctgtatcctacggagcagaggaaaaatctgtgattcgggtgggttttcccacacagtcaggcctaaccatgaaggatgacaacggcaattataccggctacacctacgattatctgaaggagattgcccagtacaccggttggacctatgagttcgtggaagcggaaggctccatggaccagcagctggttcaattgatggatatgctggaaaagggagaactggaccttctgggggccatgaataataacgagcagacttctgctgttttcgattttcccagcgagaactacggcaatgcatacagtgtgattgcggtcagaggcgatgatgaccgcattgatgaatataatctttctgatttcaagggactgcgcattgccctttttaaacgtgcgaattaccataatggaaaattttaccagtatgcaaagctcaacggtatacagtatgagccggtctggtgccaggaggatggaaaacaggcggaactggtcctttccggccaggcggatgtcatgctgtcggttgacgtgtccctgccccagggattccggcctgtggcaaagttttcaccgaccccgttttactttgccaccaccaaaggaaacacccatatcatcaacgagctgaaccggtcaatctcctatatcagcgagacgaaccccacccttcaaatgaatctgtataataaatatttttccaggtccagcagccagctgtttctcaatgccatggaacggaaatacatacaggagcatcctgtgcttaaagtcctggtccatgatgggtttggtcccatccagtattacgatgaggagggaaagatacagggagtggccagggaccttttaagcagcattgcccaaaaggcaggatgggagctggagtatgtctatgcggatgattatgacgcatttgaacaggctctgaaccacggcgaggcggatgtggtcttatccatcctgtatgattatgatacggtccagaaaagagaggcactcctcagcaacccatatctggagacagagagcgtgctggtggcccacgaaggggttgacatgctgaaccttaacggtaaggtgcaggctgtctataagggtacgcgcaaatccgaggataagacggataatgtgcgtctgtacgattccctggaggaaagcctggacgcggtcgagaagggggagtgtgactacacatacagcaacagctacacggcttcctattatcagagccgtaatcagtatgaacatgtggttgtctatccccaggccagcggcgacagcgtgaaatacagcatcggtatcctgagaaaggatgacaagcagattctggcaatcctcaataagggaatccgttctattgagacaggggaactggaacaatatatctacaacaatgcacagcgcgcacagaaggtgaccttcagaacctttatcagggataactcggttcccttcatgctgtttaccctgctggccgcttccggcctgctgaccctgatttatacccactacaggagccagatgcgcatgaaaaagcagattgaactggagaatacgcgttaccgttacctgtcagatatattgaaggaggtaacctttacctatgactacggaggagatatcctgaccctttccagggaaggggttgaaatcttcggtactgctgaaagcatacagcagtattcccggtatcaaagcagcagtatagagggagagggacttccgtccctgtatcatcttctggagcagagacaggatgtggatgcggaaatcctgattatgctgccggacaggggacctgaatggtaccgcgcggtcataaaggtgatttttgatggaaaccaggctgattcagccattggccgcctgcagaatatccatggtgagaagctggaaagggagcgcctggagcaccggagcaagcgggacggccttacgggaatctacaatattgcagcagcaaaaaaagagattacgcagatgatggcccagcacacccatgcactggcgctggctgttattgacttagacggttttaaggaaatcaatgaccgctacggccactatacaggcgaccaggtgctgattcatacagcggaagcactgaatgaaaccttttgtgatggggcggttactgcgcgcctgggcggtgatgaattcattgcctgtatcccctatacaggcaacggccctctgacggaacgctgtaatgctctgtttgagtcactgcaggccaggtgcagggcagcaggccatccggtcataactgtcagcatgggcatatccataagccgcaaggaggatgactatacctccctttatcagagggcggacgccgtgctctatgaaataaaaaagagcggcaagaacagttaccggattgaagcggaagcgcacagggattcatatccaggcatggaacaggaacatcacacggtacagtaaagagggagagaatcatggagcaggataggaatttatatgaaaaaccgcttttagatgagctggaagaaatcatctatgtcagcgatatccgtgactacagcctgctttatcttaaccgggcaggcagggaactgacgggtcttaagcaggaagacgtgataaacagcaaatgtcatagtgtacttcagggaagggatacaccctgccctttctgtaccaatgccaagctgaataaggactgcttttatgtgtgggaatatgagaatccccatttaaacaaaaacttcattgtaaaggataagctggtggagtggcagggaaggtctgcccgcatggaaatcgcggtggatgtgggtgaccgtatgaaggagcgctataaccgtacatccaagtaccacctggagaccgttatgctggaaacgctgcgtgtcctgaacaccgcggactgcctggatgaggccatcaaccggaccctggaaatcatcgctggtttttacgacggtgagcgggcctatatcatagaaatcgaccgggtacagggatatgcccgcaatacctatgaatggtgcagggccggaattccatcccagaaagcagccctgcagcgggtgcccctggatgatattccctatttgtttgagacctttaacaggaaacagcatctgattatctccaggaccggtgagcttagggattcctatcccagcgagtaccggtatctgaccgccagaaataccagcagcctttttgcagtgccctttgaagacgagtctaccttcagcggatatattggaatcgacaatcccaacatcaaccaggatactatccggctgctggattccattgcctacaatattgcgaatgagataaaaaagaggcggctctatgaacggctggagtatgaggctacccatgacgacctcagcggcctgttaaacagagacagcttcgtgcatttccgggatgatttggtgagaagcggcaccacggtttcctgcggcattgtggccggggatatcaatgatttaaagcagttaaaccgggattacggccaaagaaaaggggatctgaccatcacagaagtgtcgtccatcatggcttcctactttgccggcggcagcatattccggctcagcggggatgagtttatcattgtcagcctggaatcaggatacgaggaattcatggaacaggtcaggaaaatggaatgggcgctggataaccgcacccccaacggcgtctccctgggatgtacatgggaggagcatctgactgactttgaccggctgatgcgtcacgcggaagagctgatgctggtaaacaaacagctttattataaggacagcagccaggagcgcaaacactattcgccggaggacctgaaccgtctgctccagggcatggaagacggctgttaccacctttacctccagccaaagtataatcccctgaccggaaaggtatgctccgccgaggccctggtacggtatcggtctgccggagcggagtccaggcagccgttgaattttgtgcccctgttggagaaatcaaagctgatacggtatctggatttttatatgctggaacaggtatttaagcttctcaccgactggaagaagaggggcagggagcttattcctgtgtcggtcaacttctcccgaatcacgctgcttgaacgggacctgttccaggtgcttacggatatgcagaaaaaatacgatataccgccccggctggtgatgattgagattacggaaagcataggggacattgaacgcaaggtcattgaatccattggttccaagctcagggaagccggattccggatttccctggatgatttcggagccaactatgcaaatatgtccattctttccattatgcagtttgacgaggtgaagctggataaatccctgatggatgacctggtggtgaaccggaccaaccagaccgtggtaaagtgcatcattgagatgtgccacagcctgcaggtggaatgtgtggcagagggagtggagaaccaggaacagctggagcttctgacctcctttggatgcacggccatccagggttactattacagcagacctctggatatagaagaatttgaacggatttaaaggttaaggcagatataaaccaagaataaaatataggacggactgcaaaaaggcccttttcccgcagtaaaatgccggaagtgggcctttgattctgtatatttaacctgtgtacggttaacccttatccatatgcttcatatgccgctcctcaaattcctcagggctcacaggctttgagaaataaaatccctgtacggaatcagcctgcaggctgagcacggtttccagttcccctttttcttccaccccttccgcgcatacggatatacccacgctgtggcagagattaatcacagacccgatgaaggaacggttgaaggtatgggactggtcgcagattccccgtatgaattcccggtcaatcttcacaatgtcggccggtgtgcaggacaggcagctcagggaagagtagccggtgccgaaatcatccatggccagccggatgttaaggctgcgcaggcgtttaaaggtatcgtttaaacggtcctggtccgtgacaaaccggctctccgtcagctccagcacaatatggcaggggtccaggccgtaccgttcaatgatttccctgacagaccggacaaagtcctcatccagcatctgcaggtaggagcagttgacattcatcacaaagtcaggcgcgcaggcaagccaccggcagcactggcggacagactgttccagcacccactttcccaccgggatgatgaggccgctggattccagtaaggggataaactcaaagggagagacaggccccatgtcctcgcaggaccagcgcagcagcgcctcggcctccgcaactttcgtgtcgcttgagcgcacaatgggctggtagaccacggagaatccctccatacggttcatgacgctgcttctcagacggtccatgatttccagggagcggagcctggtatgggtcagctcctcgtcgtagagggtgcacttattcttgcccttgtgcttggaagcctccagggcgccggaggcacaggtcaaaagctccgtatagctggagccatcctgccggaacaccgcgattccgccggataccgtacagtagtactggattccgtccacctcatgacggcagtcactgtagctgtttataacctcgtagagcagttctatctcaccgtaggacatgttcctgcacacgatgacaaactggtccccgtcatggcggtatatgctggtgtaatccggcagcagcctctggacgttctgggcaaactggcgcaggacggaatcgccgtatatgtggcccttcagattgttgattcctgagaaatcatccaggcccaagagcaggattccgccatcctgtccttcgcacaggcattcctccaccacgcgttcacactcctgctgcatgaacaggccagtgacatagtccacctttcctctgtggcttaagtttgtcacaatgcctgcgaacattacgggactgccattcctgtccctctggaggataccgcggcatataacccacacgtactcgttcttccggttgcggacctgatactccacatcatgcacatccgtaaggccgttcagcatctgttctatggactcttcatagcgtgccttgtcacgttcgtgaatcaggccgccccagagaggcaccagtccggtcacgattctgcccggaagttcaaaatccctgaccatgttttccgataccagggatgtgtccgtcttcatattgatgatatagacataatcatctgtgctctttacaatggcatcgtagaatagggctgcatccagttcaaatccgaattgtcccagaatatctgttctatcatttgtcatatcgttcacctgcaaaatggagtgggaggggcattgctgcaaagatgcccccataaggtctattgcacctattttaccatgttatgggcagattgtctaacgactttgtaaagttgtgcgggtatgtatatttctgccgtatgtgcgtcccgggcggacatatccgggggcttgcaattcccctgaaaccagtgaaaaaacatattgatttatagaatgatatctagtatattataagttgtatgcaggaccgaaaggagagtcattatgattaaagtagcggtagacgccatgggcggggattatgcgccaggcgagatggtagccggagcagtggaggctgtgaacgcaaaacctggtatccgggtacttcttgtgggacagaagcaggcagttgtttccgaactgtcaaagcacacctatgacaaggaccagattcaggtggtgaacgccacggaagtcattgccaccgaggagccgccggttaacgctatccgtaagaagaaggactcttccattgtggtaggcatgaaccttgtaaaacagggggaagccgatgcctttgtgtccgccggaagctccggtgcaattctggtaggcggacaggtgatagtgggccgcattaagggtgtggaacgtccgccccttgcaccgctcatccctacggagaagggcgtatcacttttaattgactgtggtgccaatgtggatgccagagcgtcccacctggtgcagtttgcccagatgggttccgtctatatggagcacgtgatgggtattaagaacccgcgggtggccattgtcaatatcggtgcggaggaagaaaaaggcaatgcgctggtgaaggaaacatttccgctgttaaaggaatgtaaaggaatcaacttcatcggaagcattgaagccagggaaattccccatggcggagcggatgtcattgtctgtgaggcatttgtgggcaatgtaatcctgaagctgtatgagggggttggggccactttaatcagtatggtgaagggcggtatgatgtccaccatgcgcagcaagattggcgcccttttggtgaagccggccctcaaggagacgctaaagtcctttgacggcagccagtacggcggagcaccccttttgggtctgaaaggccttgtggtcaagacccacggcaattcaaagcgcacggaggtgcgcaattccattattcaatgtgtgacgtttaaggaacaggatatcaatggaaaaatccgtcagtgcctggacgttcagaacgaagaataagtccgaaggacgaagtaaaaaacatgatttaagaaagaggagctaagagatggaatttgagaaattacagggtattatcgcagaagtgttgaacattgaaccggaggatgtgacaatggcagctacattcgtagatgacctgggtgcggattcactggacattttccagattatcatgggaattgaagaggaattcgacattgagattccaaatgaagctgcagaacagattgtgacagtaggcgatgcagttgagcagattaagaacgctttaaactaacggacaggcacaggggctgtaagcacagccctttttgtgcgtttgagaggcaagttttggatgcctgtcccaggggtatttgaagaaagaaggaacaattatgaacagtcatttaaaagaactggaagagaggatttcatacgagtttaagaataagaacctgtttacccaggctctgacccacagctcctatgccaacgagcatcgtctggaccacagcaggtgtaatgagcgcctggaatttctgggggacgctgtcctggaaatcgtgaccagcgaatttctctaccgcaagtatgagacgctgccggagggggacctgacgaaaatcagggccagcattgtgtgcgaacccaccctggcgtactgcgcaggggacattgaactgggccagtacctgtacctgggcaagggtgaggatgccaccggcgggcggggacgcaattccgtggtatcagatgccatggaggcactgattggcgcaatttatctggacggtggttttgctaatgcaaaagagttcattcatcgttttatcctgaacgacattgaacacaaacagctcttttatgatagcaagactatcttacaggagatggtgcagagccgccaggaggcgcctctgtcctatgaaatcatccgtgaggagggaccggaccacaataaatcctttgaggtctgcgccaaaatcggggatgaggaggtgggccgcggtgcggggcgtaccaaaaaggcggcggaacaggtggctgcctataacggcatcctgaagcttaaggcccaggaggccgcagcagaagaataagcaggtggactatgtatttaaaaagtattgagattcaggggtttaaatcctttgccaataagctggtatttgaattccataacggcattaccggcatcgtgggccccaacggcagcggcaagagcaatgtggccgatgcggtccgctgggtgctgggcgagcagcgcatcaagcagctgcgcggcgccagcatgcaggatgtcatctttgcgggaaccgaaatgagaaagccccaggggtttgcctatgtggccattaccctggacaacagcgaccatcagctggccatagactatgaccaggtgacggtatcccgccgcctctaccgttccggcgagagcgagtatatgattaacggcagcgcctgcagacttaaggatatcaacgagctgttctatgacacgggtatcggcaaagaaggatactccatcatcggacagggtcagattgataaaatactcagcggcaagccggaagaacgccgggagctttttgatgaagctgccggtatcgttaaatttaagcgccgtaaggccattgcgcagaaaaaactggaggatgagcaggccaatctggtccgcgtaagcgacattctgtctgagctggagaagcaggtgggtcccctggaacgccagtcccgggcagccagagagtatcttcagttaaaggacagccttaagatatgcgacgccaacctgttcctcatggagacagagggaacaggaaagcagctggaggaggtggaaaagcgctatcaggttctctccggcgatatggaggacacgggcagggagtctgagcgcctgaaggccggataccaggagctggagcagaccctggcggacctggagcgccgcatggcggccggccgggatgagctgagccggggcacggtgcaaaaaggcaatctggaaggacagattaatgtcctgaacgaacagatacatacggaagaaatgaaccaggagcatctggagcacaggcgggacgtgattaccggtgaactggctgccaaaaaccagcagctggcctcctacaaagaagaattaacagccatgggcagccaggtaagggatgccttaaagcgccaggaggaagccggcgcagacctggcgggacaggacgaggctatccgccgattggaggaagccatcgaaggggctaagaccagcatcatacaggcccttaacgagcgggcctccctgacagccaggcagcagcgctatgagaccatgctggagcaggtgaatctgcggcgcagcgaggtgtcccagaagcttctcaggttcaagagcgacgagtcggtgcaggacgagcttataggcagggaacgggctttgctggaccagctgaatgaggagatggagcagaagcagttcgctgcccaggaggccgaggacgccctccttaaggcggaacaggaatcccgccgcctgaaccggaacttaaacgatacccagcaggaataccatatggcttataccaagctggaatcccttaagaacctggcggagcgctacgacggctacggcaacagcatccgcagggtcatggaggtgcgggaccgggtacacggcatccacggcgtggtggctgacatcatcaccaccagccagaaatatgagacagccattgagacagccctgggcggaagcatccagaacattgtgacggattcagaggcaacggccaaacagctcattgaatatctgaaaaagaataaatacggcagggctaccttccttccgctgaccagcataaacggcagacagacattttcccagccggccgcccttaaggaaaagggggtcctgggactggccagcgatttggtccaggtggattcacggtatgagggcctgtccaggtatctgttgggcagggttgtggtggctgacaccattgacaatgccattgcgctggccaggaaatataagtacagcctgcgtatcgtcactctggagggcgagcttttaagcgccggcggttccatgacaggcggcgcctttaagaattccagcaacctgctgggccgccgcagggagattgaggaactggagaacgcctgcagcaaagcgctggtccaggtggagaagatacaaaaggaactgaacctggaagagtccctggcccaggagaaaaagggcgagctggaaaagctgcggaccgatatccagtccatggccatccgtgagaataccatccggatgaacatatcccagctggaggataagaaggcagagatagcggagtcatccacggacctggtgcgcgagcacggccagctggaggaacaggtaaaggaaatcaacgagagccgtacagccctgacccaggactcccgggaactggagcaggtgagcacccaggccaaccaggagattgaggaaaagacggttctcctggaaacttcccgtaaagagagggaaacccttgcagcggcactgtcggccctgcagatggagacgtccaacctgcgccagaagcaggactttatccgtgagaacgcagaccgtgtgtccggggaaataaagaagctgacagaggagtttgattccctggcccagggaacgggtaattccgaacaggtaattgagggcaagcgccgggagattgcccatctgggagaactgattcagaacaaccaggcgcgtatgaaggagctggagcaggtcatggcgggctatgaggccgagaaggaggagatgacctccagacagaaggcgtttctggcaaagcgtgaggaactgaccgcccgcctggcagagctggacaaggatatgttccgcatccaggcccagaaggaaaaactggaagaaaagctggaggtatccactgcctatatgtggtcggaatatgagatgacctattccacggcccaggagcttaagcgggaggaataccagtctgttccggaggtaaagaagctcattgatgagctgaaatccaggataaagggtctgggaaacatcaatgtcaatgccatcgaggattacaaagaggtgtcggagcgctacgagttcatgcggacacagcatgaggacctggtcacggcccagggagagctggaaaaaatcatagaggaactggataccgggatgcggcggcagtttgaggaaaaattcggtgaaatccgtgctgaattcgacaaggtctttaaggaattgttcggaggaggacggggcacactggaactgatggaagaggaggatatcctggaggcaggcatacaaatcatagcccagccgccaggcaagaagctgcagaacatgatgcagctgtcaggcggtgaaaaggccctgacagccatttccctgctttttgccatccagaacctgaagccctccccgttctgtcttctggatgagattgaagctgccctggacgattccaatgtggaccgtttcgcgggctaccttcacaagctgaccaggaacacacagttcattgtcatcacccaccgaaggggcaccatggtctcggcagaccgtctctacggaattaccatgcaggagaagggagtgtccacgctggtcagcgtgaacctcattgcagatgacctggataaatagcgcaggttgtgatatgatgtttcatatatattcatatattataagacctaatatgtataagacgttaaaggagaatgatttatggctgagggaaagaagggttttttcgggcgtctggtagagggcctggccaagacccgcaacaacattgtgtcgggaatagattccatcttcagcggcttttccgccattgacgatgatttctatgaggagatagaggaaacccttattatgggcgatttgggaatccagaccaccatgtccattgtggaggatttgcgcaagaaggtgaaggagcagcacatccgggaaccggaggagtgcaaggagcttttaatcaacagcatcaaggagcagatggatttaggggaaaatgcatacgaatttgagcacaggaagtccgttgtcctggtcatcggcgtcaatggggtgggcaagaccacatccgtgggcaagctggcgggacagcttaaggacgacgggcgcaaggtcatactggcagctgccgataccttccgcgcagctgccattgagcagctgaccgagtgggccttccgggcgggcgtggagctcattgcccagcaggaaggctctgacccggcggctgttatctacgacgcagtggctgcggccaagtccaggaaggcggacgtgcttatctgtgatacggccggaaggcttcacaacaagaagaacctgatggaagagcttaagaaaatcaaccgcatcattgacaaggagtatccggatgcctacagggagactctggtggtattggacggcaccacgggacagaacgccctggcccaggcccgccagtttatggaggtggccgacatcacaggcatcatcctgaccaagctggacggcacggccaagggaggcatcgcagtggccatccagtccgaactgggaattcctgtaaaatacatcggaatcggtgaaaagatagacgatttgcagaaatttaatgcagatgatttcgtcaatgccctgttccacgtacagaagcaggcggaggacaatccatccttgaatttaatgcattgacgtgctatagtataggataaaagtaagggaaagaaggaccaagatatggaagaactgacactggagaaattcgaagaagcctccgagcttgtgaaggatgtgaccacagagacaaagctggtatacagcgaatatttctcagcacagacaggaaacaaggtatttttcaagccggagaacatgcagtatacaggagcctataaggtaaggggcgcctactataagatacacaccctgaccgaggatgagaagtccaagggactgattaccgcatcggccggcaaccatgcacagggcgtggcctatgcagccaagctggcgggggtaaaggccactgtggtcatgcccaccaccacacctcttatgaaggtgaaccgcaccaagagctacggcgccgatgtggttctggaaggagatgtgtttgacgaggcctgcgaacatgcgtataagctggcggatgagttcggatataccttcgtgcatccttttgacgatttggatgtggccacgggtcagggcaccattgcaatggaaatcatcaaggaactgcccaccgtggactacatactggttcccatcggcggaggcggtctgtgcaccggcgtgtccaccctggccaagcttctgaatcccaagattaaggtcatcggcgtggagcccgcaggcgccaactgcatgcaggtatcccttaaagagggaaaggtggtggggcttccccaggtaaacaccattgcagacggtacggctgtaaagcgtcccggcgaaaagctgttcccttacatacaggaaaatgtggacggcatcatcaccattgaggacagcgagctgattgtggccttccttgacatggtggagaaccacaagatgattgtggagaattccggccttctgaccgtggctgccttaaagcacctgaacgtacagaaaaagaagattgtatccatcttaagcggcggcaacatggatgtcatcaccatgtcctccattgtacagcacggcctgattgagagggaccgcgtgtttaccgtgtccgtgctgcttccggataagccgggagagctggccagggtttccgcccttcttgccaaagagcagggcaatatcattaagctggagcacaaccagttcatcagcatcaaccgcaatgctgccgtggagctgcgcatcaccatggaggcatttggaacagaccataagaaccagattgtatctgcccttaccagcgcgggctaccgcccaaagcttgtaaagttcaagggcacctacagtgagatgtaggcatcaggccggacaggatacagggggaaacgttatgcagccggaagaacatacggttactcataccattaaccgttaccggagttttcgttatgagttgattttagaaggagtggtggtgggcgccctggcaggcgccgtggtggttgccttccgctatctcattggttccgcagatgtactgctgaacatgatactggactatggtaagagccatacctggtttgtgccggtgtggattctgattctgacagccgccgcatgtgtggtatcccttctccttaaatgggattccctgatatcaggcagcggcattccccagattgagggggagatcataggtgaaatcgatgaaagctggtggcgcgtgctgctggccaagctgggaggcggcattatatccctgggatgcggattgtccctgggacgcgagggacccagcatccagctgggagccatgacggcaaaaggcttttcccggattaccagacgcgtaaagacagaggaaaagctccttatcacctgcggcgccagcgccggtttatcggctgcctttaatgcgcccatcgcaggcatactgttttcactggaggaggtacataagcatttttcaccggagcttctcctttcctccatggcagcgtccattacttcggatttcgtatccaggaatgtgtttggcctaacgcctgtattttcctttcacatcacccatatgatgcctctgggcacctatggccatgtgctggttctgggcgtgctcatgggcgccatgggcgtggtatataataccaccctgtccaaaacccaggatttatacgggaagataccctggaggacagtgaagcttctgattccctttttgctggcaggcgtgttcggcttcacataccgcagtgtactgggaggcggccatgccctggtggaagaactgtccgccggggagatggcgctgggcgccctgtgcctgctgctggtggtcaaatttaccttcagcatggtaagctttggctccggggcgccgggaggcatcttcctgcctctgctggtcatgggcgccatcataggaagtatatattacaatgtagccctcctggccagcccctctttgagcggtctggtggggaacttcatcatactgggcatggcgggctatttctcagccattgtgcgggcgcctatcacaggcattatcctgattagtgagatgaccgggtccttttcccatctgctgaccttatccatggtttcactggcagcctatctggtgccggatatggtccactgcgcaccggtgtacgaccagctccttcaccgtcttctggcaaaacagaatccggacaagaaggttacgctaacaggggaaaaggtgctggtggaaggcatgatataccatggaagcgcggctgagggcaggaaggtttcagccattgcctggcccaggacatccctggtggtgtcgcttatgcgcggggaagctgagtttgtgcccagaggcgataccgtgctcagggcaggggacaagattgtggtgctgtgcgacgagacttcccaggggcagcttcacagggcgctgcaggagtattgtgagacagtggctcccatgcagaaggggcgttaatgcctggacatgggcggatggaaggaggaattatatgaatcaatttaaacggcttttcggcaggaaagggattctgctggctgtagctctgacagctctgctggcggcagggtgcaggggcggccagaaagagcctgcaaaggcttctgaggcagagacatctgccccggcggagacagacacaacagctgagacagaaaccggatcccaggaactgccaaatcccatgacagaggtaaaggatgtactggcctttgaggccataggcgtccatatggtgctgcctgagggggctgaggacgccagctttttcatcatcaaccaggaggtggctgatgcccagtttaccttggacggcgtggcatatacctacagggcttccgacacagccgaggactttgcgggaatttttgaacgttttaaggacgagaccatcacccagaactatgattacggcgacaccagcctggaggtcctgattaagaccacggacagcggcggacgcctggcttcctgggcatgggggagcaccaagtacacgctctatacggcagcccaggtggaggatgacaccattacggatttgaccatgaagctggtggaactgagccagtatgaaaagtagtctggaagaggttggcttatgctggaactgaagaattttatgccggtaaatttcctgaaaaaggagaaatttaccggcagtcacaagggaatgcgttttcgcatggaaaaactggatgtggaaggcgcggacggaccgcgcctgggtgtcaccatatggcctgagccatacggctatgacgccacgcccgaggaccaaaaggaacaaatagtcctgacctttgatacggacggcatagcgaaaggggtggactggctgaacgagcagtttgaaggccagaaagccagatggaaggctgtaagccgcagttaaagtaattaattaacaaaatcttaatttcccattgacttttctgaaaacgggcactataataagccacataaagaaaagcgccggtgcttagacagccggcgctttctctattttctgtgcagataacagatacacaaagaggtgtattgccgcagccaggtaccgggcgggcaatgcacctctttctgcgtattcccccacgaatgcgcatccccattaacaatcaacctcaaggaggaatgcattatggaattttcagcggtaaacacaatttgggtcctgttaggcgcggccctggtttttttcatgcaggcaggctttgccatggtggagactggttttacaagggcaaaaaatgcgggaaacatcattatgaagaacctgatggattttgctattgggacccctttattctggcttacaggctttggtatcatgttcggagggacaggggcctatataggaggatttgacccgctggtgcggggggattattccggaatccttccggcaggcgttccccttcctgcctacctgattttccagaccgtgttctgcgcaacagcagcaaccattgtgtcgggagccatggcagaacgcaccaaattcatttcttattgtatctacagcgcggtcatcagcgcagtggtttatcctgtgtcagggcactggatttggggcggcggatggctggccaggatgggatttcacgattttgcaggttccacggccgtccatatgtgcggaggcgtcgcagccctgattggggcaaaggtgctgggaccgcgtatcggtaagtacacggaggacggaaagcccaatgcgattctgggccacagccttaccctgggcgcccttggagtgtttattctctggttctgctggtttggttttaacggctgctccacagttgccatggacagcgatgcagccgtatattccgcaggcaatatctttgtaaccaccaacctggcggctgccacagccacggttgctaccatgattatcacctggctccgctacgggaaaccggacatttccatgacgctgaacggttccctggccggtctggtggcaatcacggccggctgcgatatggtcagccctgcgggcgcgtttttcattggactgacagcggcttttgtggttgtattcggcattgaattcattgataaggtgtgcaggattgacgacccggtgggcgccatcggggtccacggcatgtgcggagcagccggaacgcttctcaccggcgtgtttgcagtggacggaggccttgtatacggcggcggattttccttcctgggaatacagtttttaggcgttgtttccgttatcctgtgggtgagcgtgaccatggttatcaccttttatgtgctgaagcacaccatcggcctcagggccagtgaggaggaggaaaccaagggactggatgtcacagaacacaatctggccagctcctatgcggatttcatgcccatggtgtttaccggaaaggcgcaaggtcaggcagaaggcgcgggggcggacagggtacccgtggaaaaggccgtgccggtggaacattatccatcatccgaaccagcgtccgccgatgtcaaattgtcaaaggtggtgatggtgttcaaccaggccaggtttactgcccttaaggacgcccttacggatttgggcgttaccggcatgaccatcacccaggtcatgggctgcggaacacagaaaggccatgtgaattactaccggggtatccgggtggaggaggcggcccttcttccaaaggtaaagctggaagtggtggtgagcaggattcctgtggaggatgtcatagagacagccagaaaagccctatacacaggcagcatcggagacggaaagatatttgtgtacgacgtggagaacgtggtaaaggtccgcaccggagagcagggatatgacgcgctccagggagaataagacaatcaatgtgctcctgtgagaataagtcaactgtttgacaaatatggcattggatatgaattatggcatccaatgctgtattttttgtattccttctgctataatataacggaatcaggaacagacactcagggggagttaaaatgaaggagacaggggacagttgtgatatcagggcagtgataaagtttgcaggagcttttattgcctggattatcgggtcgggttttgctacgggtcaggagattcttcagtttttttccagttatggatactgcagctatggtgtggtactgctgaatctccttggctttttatttttgggtcaggtactgcttaccaccggatatgaccacagggatgagagggatttcaaccattttatctttttctgcggaaagaaggcaggaagattttattcatggctgattccggtcactcttctgatgattatggcggtgcttatttccggagccggggccaccctatcagagtattacggcataaaccgttatctgggttccgtgataatggctgtcatggtcctatgtgcttatctgaccggatttgaaaaactgattcgaattgtttccaccatcggacctgttattatcgcattcaccctgatggtcggcctgaccaccgtaatccgcggttttggaaacctgtcccaaatccccggatataaggcggtgccgggcgcatcccggtcagcccccagctggctggtcagctctgtcctttacatatccctgaattttctcagcggcagcacctatttcacagccctgggaatggcggcccgcagcagaaaggaagccaggtggggcgcaatagggggcgcctttaccatgatactggccatcgccatcatgaacaccgccattttactccactcagaggatgccggggccctggacattcccaccctgtacctggccaaacacatttcctatgtgctgggcgctgtcttctccattgttctggtcctgggcatgttttcttcctgctccactatgatgtggacggtctgcagccgtatcccatcccttaccccagccagaaacaggatgacagcagctacggcggcagcggctgcgtttctgctggggatgcttcccttcagccgtttaatcaatgtattttatccctttgttggctatatgggattgatttatataggatgcgtggtttataaagggctggggtcaatgaggccaggcaaaaagagagcagcgaagcctgacagtccgtcatcatgaatgtgaggacaagggagcgggagagcagatgagcctcaaggacctgatataggacccgcctgtcagcttctccaaaacatggagttaccctctatgtaagcctctgtttcacccatgtccttcatccaggacaggtaggaacgtatggtgcttcccaccagaacatgctgctggaaggtcatgaccaggccatagtggtcaaaaacctccttaagcagtgtctcgaaggtcttgggaacgcggcacagctccagaagcaggtcccttatctccatgacgcattccctgttatagtctgccagggcagctacattgccggaggcttcggcgtgggccggcacaaacaggtttgccttcatggccgccactttatccaatgtctccagataggccgccacgtcatatataaaggacacccggtatttttccagggtggcgcggctgctgagacagtcggccagaaatacggtatcatccggggtgcgtatgccaatcatctgaaagaaatggccgggaagaggaatcagttccaaatcttttaacagcaggtcctttgacagctgggtcacatccatcacatcgctttcctgggccatcaggaacttatgccgcaggtccttaaagggataaccgccatagagaaaagccggttccaatatggggtatctggtaaaagcagcttccatgctgctggcgtaaatccggcagccggtctgctgctgcagatatttgtttccgccaatgtggtccgcattggagtgggtgttgatgatggcgtggagcccccagccctcccgctccagaatctggcgcaccttgcggccggcatccttatcattgccgctgtcaatcagacagactttctcatcatcaatcagatacacacctattttgaccggacaatttatatagaagcttctgggtccggcctgaatcaattcatacatgggatttcccttcctttcacaatttaaattagtactatgataccacaggaacagcttaaaggaaagaaagaaaatagggaatgggcgtgcagcccggaaaaaccatgcttgaactttctgtcaattcctgtataattattcagagaaaatcacgctgctttccggtataaccgggcggcggaaaaataacaggaggaaaattacgtgctattaaatggaataagaggtttctgcatggccctggcggacagcgttccgggggtgtccggaggaaccattgcttttttactgggtttttatgataccttcattgaatccctgaatgaccttatgggccgggacaacagcagaagaaagagtgcctttttgttcttggtaaagctgggagtgggatgggtcgccggcttctgcatgtcggttctgattctgtccagcctctttgaggcacatatctatcaaatcagctccctgtttctgggactgaccctgttcgccattcccatggtgattcgcgaggaaaaggaagtgttaaagggcagatacggaaatattatctttactctggcaggagtcctgctggtattctgtatcacctattttaatccctcgggcggagagggcatccgtgtatccgtggaacacctttcactggggctggtggtgtatgtgttcttcacagccatgattgccattacagccatggtgctgcccggcatctcaggttccacactgcttcttatattcgggctttatgtgcccatcataggggctgtgaaggaattcctgcacatgaatatggactattttcccattctgatggtattcggcctgggcgtcatcaccggaatcgtaggtattattaaaatcatcaagatgtgcctggaacggtaccgttcccagaccatctataccatcatcggcctgatgacaggctctctctatgccattaccatggggccgaccaccctggatgtgcccagggagcccatgcgtttttccaccttcagtatcctgttttttatactgggcggcgtgattctggcggggctggaatttttaaagaagcgtctggaccagtagaaacgtataagagggaagcagtatgggaaaaatcgtgcttctggcgccatgggaggaaatgctctgcccggcccataacctgatgaaatatccttccaatatcagtccctttcttccggcggacaggcccccatgggccgtctgccttttttgtgcttcagcgccatgagggcctaaaaaacaggatagtaagacgcagcctgtgtatttgaaagattttgcaatatattttaaaaataattacaaaatctttcaatttatattgaaatatatgcagtaatatgatataaataaggtaacaaacaaaaagatagggatgatgagatgagaacattgcaaattcctgcacaaagacaacagatgattctggattatataaggaaacaggagggagccaatattaaagaactggcatcctatctggaggtatcagaggcaacggtaaggcgtgacctggataatctggcggaggcaggggaaattgaacgcacccatggcggagcggtacagccgcaggaaaagataatcgaatatacatatgacaccaagatggagctgcgcagggaggaaaaaacgcgcattgcaaaggaagtggcgaagatggtcaaagacggcgacaatgtctatctgggttccggaaccaccgtgtactttgtggcccgagaaattgccgggcttgagaatctgaccatcataacaagcaacctgtacattgcgcagttccttcccatccatcctaccagcagcctgatagtaaccggaggggaacggcggtttgattacaacctgatgacaggacggcttgcagaggattttctcaggaacataaaggtggacatcagcatcctgggctgcgacgcagtggatgtgaatttcggattgtctgattctaattttgacgaggctgtcataaagcgtctggctgcacaggcagcgcggatgacggtcctggcctccgaccacagcaaattcggcaaaaccgcattatccaaggtatttgatttggatgaggcagactgcattgtcactgacaatggattggacagcggtatggaaaaggccattcatcagataacaaacttgattttagtataggggtatacaaggtcaagatttgcaataaacaaacagaagggagcaggagaaggtaaatgagttggttaaaagaggtgattgggacagagaaagcaatcattgccatgtgccacatgcaggccatgccaggtgaccccgggtacgatgggcagaaaggaatggattgggtcataaaaaacatgtatgaggatttaattgctctgcagaacggcggagtcgattctgtcatgttttcaaatgaattcagtcttccttatctgaccaaggtggataccattactgtggcagccatggcaacagccatcggggagttgaaacgctatatcaggattccctttggcgtcaatgtactgtgggacggggagaagacactggaccttgccaaagcgtgcggcgctgattttgtacgcgagatttactccggggtatacgccagtgactttgggctgtggaatacggatttcggcagggtggccaggcacagaaaaagcattgacgcggggaatgtaaggctgatattcaacattcttccggaagcggcaaagtatgtggctgacagggatattgtggagattgccaggtccacggtgtttaactgcaaagcagacgcgctgtgcgtttcaggcctgacagccgggtctgagactaattcccagatactgaagagagtcaaggatgccgtaccggatacagtggtactggcaaataccgggtgcaggcccgataccattgaagcacagctgtctgtggcagacggtgccgtggttgggactacatttaaggtggacggaaagttcgaaaacggagtggacgagaaacgggtcagggaattcatggatgtggtcaggaaattcaggggtcaggaataaaatcaggagaagacaatgaatcaaacgacttatggggtcggaaaaggagggttatatgaaaaaaacattagcggtaatgctctcaatcggaatggcgctgtcattgttcggatgccaaaaagggggcgcgcctgaaagcgcagctgatagcagcacggcaaaggagactgcaaaccagacagaacagacgcagcaggaacagcaggaacagcaggaacagcaggacgcggaagtgaccattgtctatatgcggcaggccggaaacacacaggtggaagacgaactcatcaaggagtttgaagcacagaatccgggcatccgggtccaggcagatgatgttcccacagaggaatgttataacaaacttgccctgtcacacaacgcgggaaacccgccggatgtcatcatgaccttctggtccccggacgcagcagccaatggaatgcttgaaccgctgctgggcagctatgtggatgaaacagattatctgaaccgctttgtgaaatcatgccgtgagatggatacatacgacgggaacctgtacgcggtgccattcagggccggtcctgattcctggtttgcaaacaaggatatgctggacgcagcaggtcttgaaatcccggcctttggcgaggaatggaactgggataccttccgcgaatacgcagaggctttaagaaacccggatgccggaacatacggcatcggcattgtgggcggcaacaccaacggcacggagtggcagttctggcccttcctgttccaggccggaggcaggataattgaaaacggaaaagccgtgttcaacagcccggagggcgtggaggcactggagtacgtgtgctccctgattcaggatgatttgattcctcccggcataaccaccacggatttgaacatgcttcaggacatgcagattgcacacaccttatgcatgtggacagacggtccctggatgctctcaaccatgaggaatacatatccggaagagaatatctgtgtcctgcccatgacaaccgcaaaaacctttggaaacctttccggaggaacctcacttggcatgtcgtccatatccaaacataaggaggaggcatggaaattcatcgaattcatgacctcagacgaagtgctgctcaaatggaataagggaaccggaaacgcgccgcctgtttacagcgcatgggatgacccatattacgcagaggacagggactggcaggtgatgaaggaactggccatgcaggacaatgaatacattgtgcccgccaaccattatcctgagtcaatcgcgttaaaccagattatgcggaattatctgcaggcagcttatattggggaaatgagtcccaaggatgcgctggatgcggcagctgaagagtggaatgaaatattggaaaagtatgatcccggcgcagctgacttaatatggaaataataggctaaaacctgcaaatttttgcaggtttttctaaaacggagaggcgtgcaatggattatataaaaattggaaacctgaaattcagcaggggagtcttattcatcttgccgggcatcctgttctttggcatcatggtcatctatcctgctgggtatgtcatttatctgagtcttttcacagaggggaagggacttggactggcgccggaatttatcggtctgaaaaactatatgaccgtcttttcatccaggaatttcgtgaagatactgtcaaatacgctgttatattccttctttgcaaccgcgttccatatcatcatcggtttgtttatggcagtgctcctgaacaataaggtgctgaagagaaggacccttacaatcggccggtccctgttccttataccatgggccatatcgccgtccgtggtggccattatgtttcaggtcatgcttcatcccaaggtgggaccggtgggaatcatcttaaggacattcaatcccagaatcgcatttaatccgctgggaagtccttccctgtcactgctgaccgtgacgctgacaaacatatggaaattcacacccttttattttctgattctgctggcaggactgcaggccattgatgacgggttatacgaagcggcacgcatggacggggcctccggctggagacagttttgtgatgtcacccttccgctgatgaagaattacatcatcaccttagctgtgtttgactttgtaagcactgccgcctatatggacctgacatggattatgacaaagggcggtcctctcaattcttcagaggtactgtcaaccctggcctaccggacttcgttccagaacttccggttcggggaaggttcggctgtgggggtgctgattttcctgatatccatactatttaccacgatggcaatgaagatgatgagtgaggagtaaagccatggatgaaaagaaacagagacagaggatattggtggggactgcactggccctcatattattcatagatttgctgccctatttgtggctgctcatctcttccttcagggcctccaatgaccccttcaccaactctgtgcttcccggacagcttacgctgtccaattacgcaaatatattccgcagcgccaacatgctgcggccgttcttcaattcgctggtggtggctgtgggggcaaccgtcataaccatgatactgtcgctgctggctgcatatggtttttccagatattattttaaggggcgggaattcctgttaagctttctcgtcaacctgcggacatttccggccctgcttctggccatcgccctgtatgtgatggcggtaaaggccggattatacaacacatatataccgctgattcttgccaacaccatgatgaacctgccctttgccatctggaatgtcaagacagtcattgacggggtgccaaaggatttggaagagagcgccatggtggacggcctgtcccgctcggctgtaatatggaaaatcattgtgccggtggcgacgccgggtctggcggcaaccgccatttacgtgttcatcctcacatggaatgaatacctgtttgccaccacgttcatgaactccaatgacatgcagctggtaacagcagtcattgcatctgcagtcacccagttcggcgtggattacggatggcttatgacaacagccatgctggcgtccattcctgcaatcataatgtttatagccatccagcggtttattgtaggcggactgaccgcaggcggaattaaaggataataaagggattaggagaagattgatatgttgagattaaaagaatattgtgacagggtacgggatgatgcttacggcggaagcgtggagctggtggaagacggcatcacagccatggcatgtgagattgaggcagaggaaccggacgatatcctggaagggatagaaaggtatgtggacagcattctggccgtcacatcgcccattcttccgttaattcatctgctgaaccgctgtatgtgttttgcggaagcgcacgctgcggggagccgggacaacagcggacttaagacggctttcctggagctgctggaggacatcaggcaggaacagcgccaatgcgtggaaaagataggaaaggtgggggccaggctcattgcccgtggggataaggtggccacattctctaccagcgggtccgtcatggagattcttacatgcgcagcaggagagggcagggagataacggctgctgcctttgaggccagacccaatgcagagggataccggacgctgcgggaaatcagcggattaggcattccggtcacctttggatgcgatgcactgctgtgtaaattagtacctggcagcaaactgtttgttataggcgcggatgccattacttccaccggggaggtatatgcaaaaacaggctcctatctggctgccctggtctgcagtgaatttgggattcccttttatgtggcagcggataccagcaaatttgacccgctgtccctgctgggattccccatcaaggacagcctgcgccctgcctgcgaagtgacggacatggatgtgccggagatatcagaaattatcaatatcagtttcgaactgattccggcaaagctgattactggaatcattacggaaaaggggctgatttccccccatgcagtggggcttatgatgaagccggagaacatgagtccccgcatgattcataagctggagcaatggagggaaaactgcgacaaattaaaatagattatggggtaggtaaaggataatggataaacgctgggatgctcttgcatcaattttagtaaactattcaatcggggtcaaaccaggggaccgggtgttgattaccatgatggagacagagacagagccattggcacgggcctgttaccgggaagcggtcagggctggcggctatcccttcatcgaataccagtccgcatacctggagaaggacctgatgctgcacggcaccatggaccaggtggaatgggtcaatgagatgtgtcttaagggtatggactgggctgactgctacatagggctcagaggggcaagaaatccttatgaatggggcggtatccccggagccaggctgtctgcccataagcgttcccttggaagggtgtctgctgagagaaaccgcacccggtgggtcctgacccgcgtgcccaacgaggcatttgcacagcagtcccgtatgccgctggaagatatgatggatttttatttcaactcaactcttgtggactgggaaaaagaaagcgcggctcttcaaaaagtgaaggaattgctggcggccggcagcagcgtccgggtgacaggaaaggagaccgatattacatttaccacatccggacggatttatgcggttgcagacggccatatcaacatgcctgacggcgaggtttatacgtgtccggttgaaacaagcgtgaacggaaccatctactttgaatttccgggcgcttatgcaggaaactatattgaaggaatacggctgaccttccaggatgggaaattagtccgttcttctgctgaaaccaacgagggactgctgagggaaattcttgcaacagatgaaggggcctctaccctgggagaatttggtatagggctgaattacggtatcaccgggtattgcggggatatactttacgatgaaaagataggcggaaccattcattttgccatgggccgcgggtaccccgaatgtctgggaaacgacaggtcggcgctgcactgggatatcattaaggatacccggaaggagggcgccgtgtatctggatggaaaaaaggtaatggagaagggcgtctggctgatttaaacaggaggcgcagcagaaaggggatggcataatgggtccggtccgtttgctggcaatatccggaagtcccagaaaaaagggcaacagccaatttttactggatactgtattggaatatacaaaaacattgaaatttgaggtagatgtaaagcgcatcagcttatccgaacaaaaggtggggccgtgcatgggatgtctggcctgttataaaaacagcggctgctgcgtcctgaaggatgactttgagggcgtccggcggctgtggaaaagggcagactgcatattatactgtacaccggtgtacgtggctggaatacccggacagctgaaatgcctgatggaccgtttgagcaatgcggattacgggcttgaaatcagaggcgcgcgccatatgaagaccatcggcgtcatatcccagggcggggatttcttcggaggcggcgcagagctctgcatgatggacatcatgcgccacgcagctatgatgaactgtgtgtatattccgcctgatgcctcctatataggttcaggcggatgggtctgggactcccacagcaatgccatgaaggaaaaagcaggtcttatgacagaggattaccgcctgaccctggaaacagcgcacagcatcatacagcgttccgttgaaatggcggccatcatccgttccggcagcagcagcctcagggacatcctggaaaaagacaaggcataccggtactattttgaaaaagaagacttactggagggatggtaaatgggctgtattctttcgtttgatgtgggaaccacgggtttaaagacaattgtaatcagccgggacggcagaatcctgagacactgcagcattgaatacggcatggtccaggaacaggaggggtttgcggaacaggcccctgctgtctggtgggatgcagcggtaaaaagcatccggactgttcttacagaggaattaaagaaggatatcctggccatcggagtatcgggacagttccagagtctggtaatgctggataaggattatcatcctctcaggaaggccatcttatggtgcgaccacaggggagaagagatgctgcctgaaatcaccaaccgggtcggtgaagaaaatctgttctcaatcactgcaaatcctgcgctttccggttccagtgtttcttccctcttatgggtgagaaaatatgagcctcatatttatgaacagtgcaggcacatcatgctcccccatgaatacatccggttcaggctgacaggggagtgtgtgaccgacgtcacatccgcctccagcatgcagcttttaaatgtgccggagagagcctggtccccggacttattccggaagctggacctggacagtgcaatcacaggaccgttgctggaatgcagccaagtggcgggacggaccacggcccgggcagggcgggagacaggccttccccagggcataccggtcattgcagggggcggggacagcgtagtgtctgccgttgggacaggcgttatccgggaaggcagctgttttacatccctggggacctcaggcatcatctgcacgaatacagaacgtataagaaccgacaggaagggaagggtcaatacctattgcagcgctgttccgggaaaatggtccgtcataacctgcagcatcacttcgggttttgccctcaaatggatgaaggaaaatttctgcacccctgagattgaaaccgccaggctccgccacacggatgtgtatgacgagatgagccgtcaggcgtcgcaaatagcagcaggctcagagggcctcctttttctcccttatctgatgggagacagaactccccatttaaatccagccgccaaaggcgttttccttggcgcctcatcctgccacacaagagcccacttcatacgcgctgtcatggaaggagtggcctactccctgatggacggcatatctgtcctcagggagctggacgtggctttggacgactatgtgctctgcggaggcggggcaaaggggagcctctggagaaccatcatagccgatatatacggacataacctgtcaaccgtacagaatgacagcggcgcagccatgggagcggctgtgctggctgcctatggctgcggcctgtacaaaaccctggaagaggcggcaggatgcatggtgaaacgcaatgagagcaatggatttaatcaggaaaatcatgagaactatatgaagtactgggaaatttatcgtgatatatatgtccggcttgaggacgtattttacaggttaagggaaatcacccgctgaccggcataattttaccggaaatactggaatcctccacagttgcatgttataatcaacataacgtaatagtaaataaaatataacctgtagggtgatgggatgaaaaaattggcggcggttaaaaacaggatattcctggttatgtcagcgttccttttgtgccttctttacgcttttcctgtcagggcagcggagaaagtgcgggtaggctgtgttgacatcgggaatttcatccagctggaccaggacggctatgccattgggtatggggcagactatctgaataaaatagcagaatatgcaggatgggaatatgagtatgtccaggcaccctggggagagtgcctggatatgctgcgcagtggggagctggatatactgcttcctgccgaatacagcgaggaacgggcaaaggactttcttttcagcagctacgagtgctgctttgattttgccgccctgattggccgaaaatcagatgaacgcctgttttatgatgattaccagggattccagggaatccgggtgggcatgattaaggacaatttcctcaatggtttgtttgacgagtattcaaaaaaccacggattttcctatgaagccatatattatgataccggcacccagatagtagaggccctggagcgggaagaggtagatgccattattaacggcaatatggaatacaacatgaaccagaagcttctggctaaaatcgactatatgccggcctacttcatcacatccgtggataagccgggcctgatggtacggctcaataaggccctgaggcagattttcatagacaatccctattactcagccggtctttatgaaaagtattatcatgagatggacagacagtttgccgagtttaccagggaggaaagccagtttgtgaagcaaagcggcccggtgaccgtactggtggcccggtctgactatccctttgaatggtacgatgaaaaggaaaaaacctgcaagggcgcttatgtggattatatgaggcacctgtccaaggtcagcggcctgaaatttgaatttattccccttgccccggcagaggattccgccggagaattgtttggggaaaatgcccagattcgcttgagcgtatttaaacagcaaaggggcggggtatccggcagccttaaatacaccattccctattacgactgcagcttcagcctggtgggcaaaaaggatgagcccctgaacctgtcttcccaccagcggattgcaatggtggaaaaggtaaacggcctgaaggaggtattggaagacaagtatcccaattgggaaatcgtcgcttatgaaacaccgaaagactgcctcaacgctgtggaggagggaaatgctgactgcgccatggtatctgccattaaactgtcagcggaccggaatctcctgggcatgaacctggtggtggtggatggcagcactgcagctgcgcctgtatacataggagtatcggagaatgccagtcccctgcttgcccaggtcctctccaagtccattgcaaaggcaggagagggcgccatggatgaagccgtgtacgccaccattctttcaagtaaggaaaataaggatttcagttacttcatacagtcttatcccctgtactttgcctttggggtcatagcggtctcactgctgggcgtgggaatcctgttcatgcgttacgatgcccggcaccagaaactgcagaacctgattctgcagaaaaagaatgaggagttaaaagcagccattgctatgcagacccttctgaggcgtaaggcgcagactgacgccctgaccgggctgacgaataaaagcaccactgaggagctgtgccgcgcctgtctggaacaggcccaaggggaggtctgcgccctgttcatcctggacctggatgactttaagcatattaacgaccagcgggggcatcaggccggtgatgtggtgctcagagccttcggggataccatacacaaatgcgtgcgccaggatgatgtggccggccgtatcggcggggatgaattcatgctgttcatggccggaatcaaggatacggaccagctgacacggtttgcaaaccgtatctatcaggcgttaaaggataatcctgatttcagcgccacctgcagcatggggattgccctgggccgggcaggccggatatcctatgaggaaatgttccgtatggcagacaatgccttatataaggcaaaagaagacggaaaaaataattaccatattgattctgttctggatgagccggagaacggcagggctacataagctttcccaccgcattcaacatgattgccacagaccggagggaagtggatacggcacaggtaaggaaagcccatcagttgtatccggataactgtctgggcggcagggagctggtgcttcctgcctgcataccgtaattcgtttttcaacgagatacaatttagaaattttaattcattgacagcagccctttattaaaatataatcatgggtaggctgttttattttgatgaaaaagaagaggtaattatgcgtcgtatatcctacataatcataagtctaatcatggtcttttcaatgaccaccatcactgcctttgcaaaaccggactggcccatggatacaggtgtgcagtcagaggccggcattgtcatggatatggattccggggctgtgctctttgcccagaacatacacgaacaaaagattccggccagcattaccaagctgctgacagcccttgttgtcattgaaaacaccagtgatttggacgcgccggtcacattttcacacgatgccatatacaatgtggaatccggggccggcaacaagttcaacctggaggaaggggacgtgttaagcgtccgccagtgtctctacgccatgctgctccagtcctccaaccagtctgccaatgccctggcagagcatgtggcgggaagcaggcaggcctttgtggacatgatgaaccagaggattaaagagcttggctgcaatgaaagccactttgccaatccatccggtctcaacgacgacacccagcgcaccacggcctatgacatggccattatagccagagcctgtttcaggaaccccgccgtgctggaaattgcctcagccaggacctcatccataccggccactgcaaacaaccccaacggacggaccttttccattgaacacaagatgctgctgccggatgattccaattattatccggatgcaattgcaggcaagacaggctggacatcccaggccgggcagacccttgtcacctatgccagacgggataacagaggacaggttgcagtcacccttaagagcacccagaaaacccactattccgatacaaagaccatactggatttctgctttgcaagattcaggaatgtaaatatagcggacaatgaaattgaatatgttacaggcgacgggcctgtgaccattgccggggagacatatgagccttcggaactctcctttgacagcggggcggtcattacactgcccaatgacgcacagttctcagatgccgataaggaacttgagacagatttgccggccggccatcctgagggcgccgtggccagactggtctacacctataatgagcgcaggattggagatgcatggatttacagctccagggcccaggctgtcaatgcaactccgtctgagccaggcgaggatacccctcaggagagccagtccccaaaggacggccaggataccaaaaccgcctttaagcttcccagggcagtgcttataggcggcggcgcggccctggtcctggcattgcttgcaggcggcggggccctctggtttaaaagacggcaggcagcggaacgggaacgccagcgcattctcagggaaaagcgcagacagcgtctggctgacatcggttatacggaagaggattttgaacggctgttagatgagcggagaaggcagcaggatatgcgctgaaacgcatcaaggggcagataaaattaatcaggaaagagacgcagacaggaggtttcgtgaatggctgtctgcgtctttttcggtacttaccctggacagaccggtccagggaaggaatgggaggagcgaacatcatggcatattttccgttttttgcagatattgagggaatgaaatggctgattgcaggcggcggaggcgtggccctgagaaaggtgcgggatttgcttccctacggcgcagtcatagaagtggtatcaccggacatgtcccctggtctggatgagatggctgcggacagcacttacgcggactgccttacgctgaccagaaggggttttgaggacagggacctggatggggccgactttgtcattgcagccacatctgagcctgaccttaacagccgtatatccaccctgtgcaggtcaaaacggattcctgtcaatgtggtggatgtgaaggaggaatgttcctttatttttccttccatcgtccgggagggacctgtggtggtgggaatctcaaccggcggcatgagtcctgtcattgccaggtacctgaaggcaagaatccaatctgtgatgccggacagcctgggagcgctgacagcccagctgggggcctgccgacagacaatcaaagacctgtttccggactctcccagggtccgctcagccctgttttatgagctggcggaggagggactcagccatggaggctgtctctcccgggaacagatacaaattataataaacagaaagctggaacaaggacatgaatgatatcatccgtattggaacgagaaagagcgccctggcgctgattcagacacagctggtcgctgatgaattaaggcaggtctgtcctggtatacaggttgaaatcgtcacaaaggataccctgggcgacaggatactggacaagcccctgcaggaattcggaggcaagggggtctttgtttccgagtttgaacaggccatacaggagggcgtcatagacctggcagtccacagcgccaaggaccttcccatggaactggcacagggactggacattgcagctgtatccgcccgtgaggatcccagggatgtgctggtcaccctgagaggacgcggggtctgtccaggcagcacggtccgggtcggaacctccagcccaagacggcagcttcaggtgcagatgatgcagaaaacactgtggccggaggctgccggagcagaatgcagcacccttagaggcaatgtgcatacccggctcaggaaactggaagaagagaactttgacggaatcatcctggctgcggccggattaaagaggctggggctgcttgaacaggacacctatgagtatacctttctgaacccggaggaattcattcctgcgggcggacaggggctgatggccgtggaggccaaaaccggaaccagggcccacacgctcacccagtccatggaccatggcggcggacggctgtgcctggacctggagcgaagggttcttaagctgctggacgcgggatgccatgaacccattggcatttactccgtcctcagggacggacagatggaggtatggggcgtcagcagccgtaatggagaggtgaaaagggttcatctgaccggcgggaccctgccggaggatgtggagaaactggcgttggaagcatggaaaggattgatgtgatatggagaagaagggaatggtatatctggtaggagcaggtccgggggacccggccctgatgaccctgaaaggacaggcgcttctcagctcctgtgacgccctggtctatgaccatctggcatccagacggttcctggaatgggcgccctccgcctgccgtaaaatctacgtgggcaagcaggccgggcatcactccatgaaacaggatgagataaacgccgtgctggtggagctggctctctcagggcttacggttgtccgcctaaagggcggggacccctttgtattcggacggggcggcgaggaaatccaggcgcttgaggcccggggaattccctatgaaaccgttccgggcgtgacatcggccatagcggtcccggaatgtgcgggaatccctgtgacccacaggggcataagccggagtttccacgtgattacaggccatacccaggacggaagagactgccttccccctgggtttgaagcctatggctccctgcccggcaccctggtgtttttaatgggcctgggacagcttccctccatcacagccaggctgattgagggaggaatgccgccggatacgcctgcggccgtcatcgaaaagggcacgctgcccggccagagagtggtaagagcgcctctttccggaatttgcgccagggtaacggaggaggggattggcaccccggcaattattgttgtgggacaaacagcctcctttgacatgaaatgcagccttgtgggtccgctggccggatgcagaatcggtatgattggcacacgtcattttacagacagccttggaacggccctggagcagaaaggggcggacgtatctaacatcctggatatggaagtagtttcccatgcagcaggtccggccatgcaggaagcttacaggaaccttgccgcgtatacatggcttatattcaccagcgccaacggagtccgcctgttttttcaggaactgctgcattccggcggggattaccgcctgctggggcatataaaatttgcagtcattggcgacggcaccaaaaaggaactggcgaatttcggctttcacgcggactatatgccggattccttttgtgccggggcgctggcaaaggggctggcatccatccttacccccagcgaccgcctcctcattgcccgctccaggggcggttccccgattcttaccgtaatacttggagaagccgggattgtttatgatgatattgtcctttatgaggtgggaggtaagcccgcggactcaagtatacccgccggagagggctttgactatattacctttgccagcgcctccggggttagggcgtacctttcaagcggcctgagggtgaatcccggacagaggacaggacagaccaggctggcatgtatcggtgacataacggcaggggagttgaaaaaacatggaatgaaggcggatattgtggctgaaacttaccatattcagggcctggtgaaggccattgaagaggatgtcatatccggcaaaacagagggaaagtctgcgtataacctgtagttatgaaaaatatataaataaagtataaaaaaattgttaaaatattattgatttctccgcggtaaagtggtagacttcttggcatcaagagtttgatacttgagaaaagcaatgactgggaaatgtcatggtttcagattccggcacagagagcagcccggctggtggaagggcgcgcgagaggaatcatggcctcacccaacagcttctgtcctgaactcctttcctgagagagagggtagtagggatggacgggtttctttccgttaacaaagattccggctgactgagagcagcgggaacttaaggggctgtcctgttaagggcggcaaacagagtggtaacgcggattgattcgtctctgcatcgcaaggtgcagggaccttttctttttactgggcaaactctttgaaacctactttatatacgtgaggagacttgatgatgaatggtttagtgatgatgcttttagccgtagtcatattaggcggcgcctatctgatttacggcagatatctggcaaagaaatggggggttgaccccgatgcaaagacaccggcttatgagatggaggacggtgtggactatgttccggctgataccaatgtggtgttcggccaccagtttgcctccattgcaggggcaggccccatcaacggacccatccaggccgccatgttcggctggctgcccgtcatgctgtggattctcctgggaggcgtattctttggcgcggttcaggactttgcagctatgtatgcttctgtaaagaacaaaggccgttccattggctacataatcgaggtttatatcggcaggcttggcaagagactgtttcttttattcacctggctgttctccatcctggttgtggctgcctttgccgacatcgtggcaggcaccttcaatggttttgatgccgccaccggagagcgaatcgttgccaacggagccgttgccaccacatcccttctgttcattgtgtttgcagtggcgctgggatgtttcctgaaatatggaaaatgcagcaagctggtaaacacactggctgctatcggccttcttgtgctggccgttgcactgggactggcctttccggtctatgtaccccagggcgcatggcttatattcgtattcctgtatgtgattgttgcctgcgtgacccctgtatgggccctgcttcagcccagggattatctgaacagctacctgcttctggccatgattatcggtgcggtcctgggaatctgtgtctataatccggccatcaaccttccctcctttacatcatttgtatttacagatgcaaagggaaatatttcctatctgttcccaaccctgttcgtgaccattgcctgcggcgctgtatccggtttccatgcactggtatcctccggaacagccagcaagcagattaagaatgaaaagaacatgcttcccatctccttcggcgcaatgctgctggaaagtcttttggccatcacggcactgattgccgtcggcgcgctggccaccagcgaggggctgcccgcaggtacgcctccccaggtatttgcaaaggccattgccatgttccttaccacactgggaatgccggattccatcagctacacgctgataacgctgtccatatccgcctttgccctgaccagcctggattccgtggcgcgcgtgggccgtattgctttccaggaattctttaccaatgatgagattgacccggccaatcagaattccttaaacaaagtgctgaccaacaaatatttctccaccatactgaccctggcgctctgctacgcattatccagggcaggctatgcaagcatctggcctctgttcggttccgccaaccagctgctttccgcactggctctgatagcctgcgccgtattcttaaagaagacccacagacagggcgttatgctctggggtcccatggtcatcatgctgggcgttaccttcacagccctgacccttaaaatcaaggaccttgtatcagccctgtcaaaccagtttgtattcggtaacgcgcttcagctggtgtttgcagtccttctgctgattctgggcgtgattgttgcttttgagggcatccgcaagcttatggataaggacacggaggatgataaagctgcttcaggcaaaggtgcggctgcttaaaggatgcggctgtttaaaggatgcaaaagctgaaaaaggcggatgcatcctttttcaacttgaaaaacccagtctgataacgcataataataagggatgaaccttatgataattccgaaaatattctgatacaggttccggaaagcaggataaaacatgaaactcagatacagatggactggcatactgacagcgctcgctgtcctggcagctttagcttccggcatccttgtttgcctggtatggaacggatggatacttttaaatcatccctccaggacccggtatccggtacgcggtgtggatgtgtcacattatcagggagaaatcgactgggatgtgctgggacagcaggacattgattttgcttatatcaaagcaacggagggcagttcccatgtggatgagaaattttctcagaactggtacggttcacacctgagtggtctggctgtgggagcataccacttttttagttttgacagcagcggaaaagaccagctggagcatttcacccaatgcctgcccgccagggacggaatgcttccgccggcagttgacgtggagttttacggggacaaggccgcgaaccctcccaatccaagggacgtggagcaggagcttgcagccttgctggaaggtatggaaacacagtacggtatggcccctgtcatctattgcacagaggaatcctggaatctttacatccgcggaagatttgaccggtatccgctctggattcgcaatgtgaaaacaaagccccgcacggacggcgaaccctggctgctgtggcagtatacaaaccggcagcgtctggacggctataagggagacgagacatttattgacatgaatgtgttttacggaagccgtgaacagtgggacaactggtacgggaatcgtaataaatcgtaaggagtgcccaaagactttttcttttcctcctgctatacttttggcaaagaccattatcaggaccattccatttcggaaacatgcaaaaaggcaggcaaggaggaataaagatttcacatggaaccagcaacagaagagaaaacagaacaaagacaggaaacagaacccggcaggcataagaccaacaggccgggcaggggcagagccctgattgcagctgccctggctgctgtattggtactaaccgcagcgctggctgtttttatgacaaggaacagggagaacagcagtgtaattgccggcatggattattatgagcctgctgtggatgacaaaatctatagctcatatttccagcatgatacacgctggagcagcagtcctcttggcagctcaagagacaccatgggaagttccggatgcctgacctgctgtatcgccgcctccctgacagctcagggggtacaaagtttttcaccaggggagctaaatcagattttcaatgaaaataaagtctataacgaccatggctccattgtatggaaacagctggaacaggcattgcccggcgccagggtccggctggactgcagcagtaccagcgagagcatcaaccgcctgctggcagaaaaaaagtatcccattgtaaaggtaaggcggaaaagcggggcagtacactggattatgctcaccggcacggaaaaggatacttatgatatcacggccatggaccccattgacggctttgtgcacatgagtgattatgataatactatttatggcgtcagggttgtaaccggtgacagcgggacatgggagacagcgggaacagagacagaagaaacaggcaaagccgctgaatcagccggtaccgcagccgcagacagcccgggtgaagtccttaaggtcccggacaaggcagccgcagataccggcaggacagcagatggattcctgaaaacagaagaggcatttgccctgagcgagattcagcccttttcctttgaagaacttggaaacgggtctggtatccggggcgttgtattcttatcagccctttcccagaaccaattccgcatctacggctatgtgggaccggaaaatctctataagggaatttacatcctggaccgggatggcaacatgaattcctttccctccatttcctatacctctccccagctgattcttcccaaaatcggatggaaccaggagcaaggcatattggaggcttccttccataccatgacaggcacttccctgtccagggaccagttttatgccttcctgcggtatgatacaggacatctggagccatatgagttccgggcggaggactatgaaaagcagctgtcccggcgtctgtcctataaacttgataaagaaaaaaatacagtcacattctacgatgagtcggagaaactagcagccttacccctggatgacctggacagcagccgtatccgggatgtcatatacactgattttgtgtcatttgagccaaatcaaaccgttacaatggaatttacccccggttttgtaatggacggaatggcagcgccacagtatctggaagcagatgtgcggctggaggctgccattgatgtcacgcgcgattcagactccagcggggcagatgtggtgaaattccatatcagggatattgaaaagagcgggacctgacggtcacattttacaaacaaatatacaaaaacctcttgacttggagttgactttaagttgtagactctcattatatccggggttcagcatactgcgcggactaatcccagggattatctgccccagattatctgtcccggacattctgaatcacagtccattcagactgcggtctgacaacaacatttcaaggaggcttatcattatgtctattgtttacatgacaaaggaaatcacgccggaaagcctggtccggatttaccacgcattgggcgctgctttatccggcagcgttgccgtaaagctctccacaggtgagccgggaggacacaacttcctgcagccggagcttatcggaaaccttgtacaggaactaaagggcaccattgtggagagcaacactgcctacgagggaagaaggaacacttccagggctcactgggagactatacgggaccatggattcgcagccattgccccctgtgatatcctggatgaggacggccacatgcccctgccggttacagacggctatcatctgaaagagaattatgtgggcacccatcttcaaaattatgattccatgctcatgctttcacatttcaagggccacgccatgggcggctttggaggagccttgaaaaacatgtccattggactggcatcctcgtacggcaagatttggattcattcctccggtaccagcacccggtttgaggatgtgtttacagcggaccacgattcattcctggaatccatggcagacgcggaccgctccgtcatggactacatgggccgtgaaaacatagtatacatcaatgtggccaaccgtttatccgtggactgtgactgcgacgcccatccccatgacccggagatgaaggatatcggcatttttgcatccgctgacccagtggccctggaccaggcgtgtgtggatgcggtgtatgcttccgaggatgagggaaaggcagccctgatagagcgcatggaatccagaaacgggattcataccgtggaagccgctgaaacccatggccttggcagccgcagatatgaactcaggtgcattgactgatcaaattgcagcatcaaagactaactattaaaagtcaagtctaaaataaaagttttggatgaattgcagaagtagatactctcgtatctactttttcttgtaatacccaaagtccagaaagaacccgtacacctttgcggactccttttttattgtctctttgttttggttaaattacacggattctcataaacatttgcgcgttttcccttacgcgcccctgctacccttcaatatccattatcatcttcacccggcgctcatgccttcccccctcaaactcagcgtccagccatgcctctgtaatcatcttggccagctcgcttcccactaccctggcgccaaaggcaagtacgttggagttattatgcatcctggacagctttgccgtgtaaggctcgctgcacacgcaggcccggattccctttaccttgttggctgccaaggatatgcctacgccggtgccgcagatggcgattcccaggtcagcctggccgccggccacagcccgtcctaccttttcgccgtagacagggtaatcgcagctctcagtggaattggttcccaggtcaatgacttcgtatcccttgccttccacaaactccttgatgatattcttaagctcaatggctgtgtggtcgttaccaattgcaatcttcataattcctcttctccttttatccattctctatgtcatggtttatattctaacgtttatgtttctcatatttcatacatccggcctgtcatacccggtcacgggcaaaaaattcctgcacccggtccagcctggatgtcatggacaggagcagcatgtcggctgctgtcaatgcggccatggcctccaccaccaccacggccctgggcactatgatggggtcgtggcggccctttatctcaaccactgtctcctcgcccttccggttcacggtatgctgcggctgtgcaatggagggggtgggcttaaatgccgcccgcatcacgatatcgctgccgtcgctgattcctcccagggtgcctccggagtggttggtccgctttccaaccctgccgttcaaatgcaggctgccgtcctttccctcaccgtaaatgcagaacccgtcgttgttcccggaaccgcaggccctggaagcgccaaaaccgtctccaatctcaaatcccttgactgcgccgatggacagcatggctttggccaggttggcgtccagcttctcaaatacaggctctcccgcccctgcaggcataccgcggatgatgcactccaccacgcccccgcaggagtccttacggcccatcagctcctccagccgtgcctctgcctgtgctgccgcccgggcatccggcatgtacagccggttattccacatctcttccaggtcaaagcgctcccggtcaatgccaataccgcctacctcccgtgtataagccctgaccgtgattcccaaactctctaaaagcctgcaggcaatggctccagccgccaccctggcaatggtctccctgccggatgaccggccgccgcccctgtaatccctgaaaccatacttctggtcaaaggtataatccgcatggcccggacggtaaatatccataatgttgctgtaatcccgggaacgctggtctgtgttgcgcacctccagcgcaatgggggtgccggtggttcttccctcaaacacgccggacaggatttccacctcatccccttcctgcctggctgtggtaaacttgctctggccgggcttgcggcggttcagatagaactggatatccccttcctccagaggcagtccggccggacacccgtccaccaccacaccgattccctttccgtgggattccccccaggttatcactcttaaaatcgttcccaatgtagaacctgccatatactgtctcctgtcctcctgcttctgtatcactgcagcctgtctgacggctggtaagcttaatttccaatcctggcaatggcgcagcagtttggttcatttaccatgacgctgcgtccgcacataactatcaggcccttctcgtaatccacctcaaagaaactgatgctgccgctgtcatgattaatggaggcaatgtgcttctggtccgggaaaatagccacgtccttcggatactccccgctgacaggcaggcagcaaatcatagtcagaagcccggacttctcatccctgctgtagatacttactgtattctcacctgcattggtgcagtatatgtatttctcatccggggacaatctcatggcgcaggcagctgtcaggttccccggattcctggtggccgtggtggaaatcgtctgtatcttttcaactacaggcgccctgtcgcctgtttcatatgaatacacgcagattacattctgcagctcatgcatcagatacaggaaacgtccgtcggagctgtagcggaaatgtcttggagctgactccaggtcgcagtggatggcatccacctggaacagcttcttatccttgtcgttaaagcggtagacctttacctggtccgtcccattgtccacagacagtacatatctgccatccggcatccttctggtacaggtcacatgggagcggaagttacgctcagccacgctgccgtagcccttgttgaacacctcgtccacaatcttgcccacagagccgtccttgttaaggctcaggaccgtggtcttgccgtcgtggtagcctgagacaaatacatatttatcttccatatcagtacacaggtggcagcccctcataccgcggataggagcgctgttcagtcttgcaaggcttccgttctgcagaatccggaaggatacaaccccctcatccgcgatggagtataacgtctttccatcgctggaagcaatgacataggaggagttgtccacttccatctcacacctctccttaaatgtcccgttttccacgtccacgtcgaacactgtgattccctttgcttttccggtgtaggaataagaccctacatatgccatatatttgccgctcatacctgtctgtacctccctgatttacgtcggtttctatttcaatttagactaaaaacatcatatcataaaattgtgaatttgttaactggaagtttgtgaaattatcccccctgattccccttaaaacttatctgccaaatctttcaaaaaggtattgacataccactgatttaatgtataatgaaaatcgcgcttgtttattattactaaactttttgcttatttttatagtcagttagtatttgtaaactttttgttcagaaaagcgagacagggaggaactccatggaaatcggaacgaaactaaaggaactgcgggtgttaaagggtctgacccaggaagaactggctgaccgggccgagctttccaagggattcatttcccagctggaacgtgacctcacgtctccgtccatagccaccctgatggatatcctgcaatgcctgggcaccaccatcggcgaatttttcaacgaaacaccggatgaacaggtagtatttggaaaacaggattattttgagaaaatcgatacagacttaaataatgaaatcaaatggattatccccaatgcccagaagaacgtgatggagcccatcctcctcaccctgaaggccggaggctccacctatcctgataatccccatgaaggggaggaattcgggtatgtgctccagggcagtatatccatccacataggcagcaagacatacaaggcaaaaaaaggtgaatccttctacttcacgccggataagaaacattacctgacaagtaaaaacggagcccttcttctgtgggtgagctcgccgccaagtttttaatcacattaagataaaggagaatttgattatcatgagccagcctttcatagatttacagcacatatcaaaaagttttgacggtgagctggtcctggacgacctgaatctttctatcagggagaacagcttcgtcaccctgctgggccccagcggctgcggcaagaccactaccctgcgtatattaggcggcttcaccacccctgatacaggaaaggtaatcttcggcgggcaggatatcaccatgattcctcccaacaaacgccagctgaataccgtattccagaagtatgcactgtttccccacatgaacattgcggaaaacattgcctttggcttaaaaatcaagaacaaaccaaaatcctatattgatgacaaaatcaaatacgccctgaaattagtaaacctgtccggttacgagaggcgcaccgtggactccttatccggcggccagcagcagcgtatcgccattgcccgggccattgtaaacgaacccagggtgctgctccttgacgagccccttggcgccctggatttaaagctccgccaggatatgcagtatgagctgatacgccttaaaaatgaactgggcattacctttatctatgtgacccatgaccaggaggaggccctgaccatgtcggacaccattgtggtcatgaaccagggatacatccagcagatgggctcccctgagcagatttataatgaacctgaaaatgcctttgtggctgactttatcggagagagcaacattgtgcccggcatcatgattcgggacgagctggtagaaatcttcggcgcccgctttgcatgtgttgataagggttttggcaataataagcctgtggatgtggttatccggcctgaggacatagaccttgttaagccagaggacggcaccctccagggcgttgtgacccacctgattttcaagggcgtccattatgagatggaagtaaccaccccggacggtttcgagtggctggtgcattccaccgatatgttccctgtaggccagcaggtcggcattcatgtggagccatttgaaatccaaatcatgaacaagcctgcttctgaagatgaggaggcgctgggagtcaatgaatagcgaaaaaaaaggcgctgccatcggcaaggcgctgttatcaggtccctatctcatctggatggccggctttacgctgattccgctggccatgattatatggtacggactgactgacaagggaggcggccttaccatggccaatgtcattgccattgcctctgcggaccacgcaaaggcgctgtggctgtcccttgggctatccttggtaagtacggttctctgtctgctgttagcttatccactggccatgatactcaggggccgcggaacagcggcaggaggattcattgtctttatattcatcctgcccatgtggatgaacttcctcctgaggactctggcctggcagacgctgctggagaaaaacggtgtcatcaacggcatcctgaactggctccacctgccttcacagtccatgattaacaccccgtcagccattgtactgggcatggtatataacttcctgccctttatggtgcttcccatttacaatgtgctgtccaagatagacgacaatattataaatgccgccatggacctgggagccaacagctttgaacgttttaccaggatatggtttcccttaagcataccgggcattatcagcggcattaccatggtttttgttccgtccctgaccaccttcgtgatttccgatttgctgggcggcagcaagattctgcttatcggcaatgtaattgaacaggaatttaccaggggaagcaactggcatctgggaagcggactttcactggttctcatggtcttcatcctaatcagcatggccatgatagccaaatacgataaaaacggagaggggactgcattctgatgacaaagagttcaaaagtactgcgcaaaatcgtatcggatttttatatggtgctgatactgattttcctttatgcccccatcctgaccatgatggtgctgtccttcaacaaatccaaatccaggacccagtggggcggatttaccctgcagtggtacacccagatgtttgacagccgttccatcatgagcgccctgaccaccaccttaatcatagcctttgtatcggccctggtggcaacaatcataggcacggcggcggccatctccatcagctccatgcgggcagtgcccaggaccattgttatgggcattaccaatatacctatgctgaacgctgacatcgtgactggtatttccctgatgctggccttcattgcctttggtatttccctgggatttaagacggttcttatatcccatatcacctttaatataccctatgtcatactaagcgtcatgcccaagctaaagcagaccgacaaatacacctatgaggcagccctggacctgggcgcatcccctctgtatgcatttttcaaggtggtgtttccggatattatgcccggcgtgctctccggcttcctgctggcatttaccatgtccttagacgacttcatcatcacccactttacaaagggcgcaggcatcaacaccctgtccaccctgatttacagcgaggtgaggcgcggcatccggccgtccatgtatgcactgtcatccattatattcctgaccgtgctgattcttctcatctttgttaacttccggtccatcaggaaaccggaaaaggcataaccgaattcagacattaaaggagaacgattatgaaaaagaaaatggcaatcacccttgctgccgcatccatggcagtcctgtccgccgccctcttaaccggctgcggcaaatccgaatcctcccccgggggcggaaataaggaagacaacaagctgaacgtatacaactggggcgagtacattgacgaggatgtcatcgcccagtttgaggacgaaaccggcatccaggtggtctacgatgtatttgagaccaacgaggagatgtatcctgtcattgaggcgggcgctgtgaaatacgacgttgtgtgcccctctgactacatgattcagcgcatgattgagaataaccttctggctgagcttaactttgacaacattcccaattataaggaaatcggtcaggaatacctggatatctccaagggttttgaccctgagaacaaatattccgtcccctactgctggggaaccatgggcattctctataacaccaagcgcctggaggagctgggcgttcccgctcccgccaagtggtccgacttatgggatgagcgcttaagcggcgagattctcatgcagaacagcgtaagggatgcctttaccgttgccctgaagatgaagggctactccttaaacagcaccaatcccgatgaactggccgaggcccgtgatttgctgattgagcagaaacctctggttcaggcatatgtcattgaccaggtaagggataagatgattggcgaagaagcggctgtgggcgtgatttattccggcgaaatgctctatatccaggatgccgtggcagaacagggcctggattacagcctggaatatgtaattccggaggaaggaaccaactactggattgactcctgggttatcccggccaatgcagaacacaaggaaaacgcggagaaatggattgatttcctgtgccgtcccgacatcgccaaaaagaactttgaatatatcacctacgccactccaaacacaggggcctatgatttgttagacgacgaccttaaaaataacaaggccctgttccctgaccttgacaagctgcctaactgtgaaatcatccagtatctgggggacgatgtggataccgtctacaatgacatgtggaaggaaattaaatctgaataaaaggaatcctatcatgaaataatatgaaaaggaagttctgaacggaaggcgtaaactccattcccttcctccggaacttcctctttatatttataaccctaatatactctgtctcaaactccttctgaggtcctgcggcatcataccatacagaatccggcactgccccttgtaaaatcactgcatcaccccacatgcttcccctgctcatggtttccatggcacacagaggaacctgcgcagcctccgcagccgccggcacatcctccgcatcccttacctgactttttatcctttatcatgacacggactaccgcccctacaatcacagccaatatgaccagaatgattaacgttgaaagattcatatatattctcctttcctcctgtttatatccggcgcaggcatgatgcaggtcccttttcgctgattcccaaggcgttatcctgctgttagtttccggttcttttacaggttagcttcttctaacttcattctcagattagcactttctaactctcttgtcaatcgtttttttatatgttacacttagaactatcatactaaataattgggggtatttacagacttgaaaatacaggaatcagcagaaaattatctggaaaccatactcatgctggccagggaacatccctatgtccgctccatcgacattgccaatgaacttggattttccaagcccagtgtcagcgtagccatgaagaatctccgccagaacggatatgtccggatggacgaacagggacatatcacgctgacgccttccgggcaggccattgcggacaccatgtatgaacgccacacgctgttgtccaactggctgatttatctgggtgtggaccccggaacagctgctgaggatgcctgccgcatggaacacactctgagcgctgaaagctttgacgccatcaagcgccacatcacccacggccatgaactgccggattaggaggaagcctatgttaaaagaccttgtgaaacaatgccgctcttacagaagattttatcaggatactgccattccatacagtgaactggctgatatggtggacacggcccggctggctgcctctgcctccaacgcccaggccctgaaattcaaaattctgtgcacgcccggggaatgcgctgatatcttcccatatattgcatgggcaggcgccctaaaggattgggacggccccgcagagggcgaacggccctcagcctacatagtcattgcctgcgacctgaccatcggtaagaacaaacaatgggacgacggaatcacggcccagaccatcatgctggctgccgcggaaaagggatatggcggctgtatgattggcagctgcaagcgtccggagataggccggctgctgggactgaatcccgagcattacagcatcgacctggtactggccctgggaaagccaaaggaagaagtaatacttgtgcctgtaaaggaagacggctcaactgtatattaccgtgataaaaatcaggttcattacgttcccaaacggaatctggaagatatcctcctgtaacaattccactcacccgctgcataccattcgccagaacattattcttctctcagcgtggcaaacacagcggacgccctgagtatggaatgggtgagagccgggggcacccggctctcacgtctgcggcaccctgcatgcgtccgcatcccctctcaccccaaaatccatttatcacaacgacaaagccctcatcgcattgagtattgcaataaccgacacgcccacgtctgcaaataccgcctcccacatattggccacgcccacagcacccattaagagcaccactgccttgactcccaatgcaaaggcaatgttctgctttacgatggacatagtcttgcgcgatatgcggaccacatccgcaatcctggcagggttatcatccatgagcacaatatccgctgcttcaatggctgcatcggaacccatgctgcccattgcaattccaatgtccgcccgggagagaacaggcgcgtcattgataccatcgcccacaaaggccagcctgtgttttcccgtctgctgagacagcagttcctccacctttgccaccttatcccccggaagaagctctgcatggacctcatcaagccccagcctggctgccactgcttctcctacctctttcttatcgccggtaagcataatggtccttctgacacccaccttcttaagattcctgattgcctcgaaggactcttccttaattgaatccgatatgacaatatatccgcagtacacgccgtccagagccacatagaccaccgtgcccatgctggtgcattcctgatactctacgttcatttccttcatcagcttgctgttgcccgccagtacggtatggccgtcaatttccgcctgcactccgtgaccggatatctcctgtgcattgctgacgcggttcatgtcaatggtatctccccacgcatctttaatagaacgtgaaatgggatggtctgaatagctttccgccaatgccgccagctccagcagggaacgttttgcctcatcggagggctggctggccgcccacaccctggtacgcggaacctcagacgcctccggaacaggactgccgtccaccgcatgaatctcagtcaccttgaattctcccttggtcagcgtacctgtcttatcaaacacaatggtgtccatctcagacagcgcctccagataattgctgcccttgataagcacaccctttttggaagcagccccgatgcctgagaaaaagctcatgggcactgagattaccagggcgcaggggcaggaaatgaccaggaaggtacaggcccttctgatgccctcggaccaggtctgcccaaagaacaggggaggaatcacagccaggagcacggctcccaccaccactaagggggtataatatctggcaaaccgggtaatgaagttttccacctgcgcctttttgctgctggcattctccaccagctccagaatctttgccacggtggaatcatcaaattcctttgtgacctgaacccgcaaaaggccgcttccattgacacagccgctgatgatatcgtcccccgctgttaccttgcggggtacggactcaccggtcagcgcggaagtatccaccatggaatccccaaacaccaccttgccgtccaggggaattctctcccctgacttaaccacaatgatatcgcccacctgcacatcgtccgggtccacctgtttcagctggccgtcctcctctatgttggcatactccgggcagatatccataagctcagtgatggactgcctggagcggttcactgcatagctctggaacagttcgcccacctggtaaaacagcatgaccgccactgcctccgaatattctcctacgccaaaggcgccgaaggtagctactgtcatcagaaaattctcatcaaaaacctggccgttgcgtatattgcggaatgccttgtatataatatcccatccaatgagaacatagggaaccagatacaggaccagctttccccacaacccaagccactccggtaaaatctccatgtggtctgtcactgccagggtaatataaatgatgaaggatgctatgatacggagcagcattgccttttgtttcttagtcatatcagtttcctttccagtccggctgcgcgtttaaagctggataatgcagtcaggctccacctttttgcacgcagacactacttccttcataatttcatcgaacctactgtcatctgcctctatggtcatcttctgggtcatgaagctcactgttgcatcagacactccctcaattttcttgattgcttcctccatcttggctgcgcagttggcacaatccaggtcctgcagtttgaatttcttcttcattcctattctcctccatatctgttattttatttatactccattttccgccggcaccatctgtagcttatgcaagccggaaatactgggccataatacatggaaccgcccttttggcctattcctctatatgctccataccctggttaatgatggtcctcacatggctgtctgccagggaatagaatacagccttgccgtccctgcggctttttaccagcctgttctgcttcaggattctcagctggtgggaaatagctgactggttcatattaagaagctgcgcaatgtcacagacacacatctccgcctcgaaaagcacatacaatatcttgattctggtggaatccccaaacaccttgaatatctccgccaggtcatacagtttatcctcatccggcatcttatcattaaccgcctttaccacatcctcatggacctgataaaaatcgcagcactccacatcatttattgccatggctggtaccctctctttcttattatcatctattcaaatgaataagtgttcatatgtttatatctacattatatgccatgattttaaaatgtcaacccctttttagcaaaaaaaacaagccgcccaatcccgtattacaccggacggacggcttgctggccttccaaaaatcacatatacttatataccgctttcttctccagaagcaaccgcaatatgcagttcctccagctgtttcacatctacctgcccgggcgcatcggtcatcaggcaggatgcatccttcaccttggggaacgcaatgacgtcgcggatactgtcagctcccaccatcagcattatcacgcggtccaggccatatgccagaccggcgtggggaggaaccccgtacttaaatgcctccagcagaaagccgaactgctcattggccctctcaggtgtaaagcccagtacttcaaacatcttggactggatatctgcctggtggatacggacagagccgcctcccaactccacgccgttcaggacaatatcatatgccttggcccggacacggcccgggtcagagtcaatatactgcaaatcctcatccatgggcatggtaaatggatgatgcatggccacgtaccggtcctcttcctctgaatattccagaagcgggaactctgtcacccacaggaacttaaagtcatccttcttaagcagctccagctgtctggccagctccaggcgcaggttgcccaggacgtcaaataccaccttattgcggtcggcggcaaacagcagcaaatctcccggctttccgtccatggcctgaatcagggcagccatttcctcctccttcatgaactttgcaaaggaggatttgaaggtgccgtcctcattgattgccacataggcaaggcccttggcgccgaatcccttggcatactccaccagggcgtctattttcttacgcggcatatgcccctgtccctgggcgttgatgccgcggacactgccgccgttttccagggctcccttaaacactgcaaacccgcagcccctaaccacatcagaaacattcttaagctccatcccaaaacgcaggtccggtttatcagagccaaaacggtccatggcctcctgccaggtcatacggggaatgggcagctgcaaatcaaaattacagatttccttaaacagcttttttaacaggcgctcattgacatccagcacatcgtccacatccacaaaggaaagctccatgtctatctgtgtgaactcaggctggcggtctgccctcaggtcctcatccctgtagcagcgggccagctgaaagtagcggtcgtaaccggaacacatgagcagctgtttgaaaagctgcggtgactgcggcagggcataaaaggaaccgggatgcacacggctgggtaccagatagtccctggcgccctccggcgtactcttaatcagagtaggcgtctcaatctcaaggaatccctcagacgccagaaatgccctggtaagggtggctacctggctcctaatcataagatttttctggatatccggccttctcaaatccaggaaacggtatttcaggcgaagctcttcctttgtcttgctgttctcctcaatggggaagggaggtgtctcggactcggaaagaatgcgcatggagttggcccttatttcaatggcgcctgtggccagattggtatttactgctccggaacgggcctctacccggcctgtaacagcgaccacgaactcgctcctcagcttctctgcctttgcaaagtcctctgcgccgcagtcatgttcctcaaatataatctgaaggatgccggaacggtcccgcaaatccacaaagataatgcctcccttattcctgctcttctggacccatcccatgacggtcactacctgaccgatttgggcagtggtcacctccgtacatctatgggtacgctttaacccaaccattgattctgccattgtcttatctcctttattttccttaattcttcaggctttccttataaaactccttaaactccgtgtagccttccttgcccagctgttccttctggaacttcttgttcttgttcatctgggctaccaggacctgcacgcccttctttctctcctccatggcctggcggattacagatgccagcatggtgctgtccacacccttttcaaagagaaatgcctttctggaagaggcgccgggcacagtaaagccattgtccgtcagaatggttacaatgcgctcaaagcctatggaaaatccgcaggccggcgtttccattcccgtgaacttgcctatcatcttatcataccggccgccgcctgccacggaaccgccgaagccctccatggaaacttcaaaaatggttcctgtgtaatatgacatgcctctgaccagggtagggtcgaactccagcccgaaatcagcctcagccacctcagtcactgtgtccatgatatgcgccagaccctcgcttacactggcgggcattacttccgacagcatctgtcccagggctcttacaccggctgcatcctttgtaacatttttaagcatgtccagatattttcctacgctctccgtgctgtagccggaatccagaagctccttctccacgccttcatacccaatcttatccatcttgtccagggtgataaatacctggtccatggactcctcagggaaaccgcagtaaagggccataccccgcagaatgcctctgtcattgatgcggacagtaaagccattgtccgggcagattcttcccagggccgtggtggtagccagaatcagctcgatttcagccaggctggtggcatctcccagaatatcaatatcgcactgtacaaactggcggaaacggcccttctggggacggtccgcacgccacacgcttcccatctgaagcgccttaaaggggctgggcaggctggctgcgttgttggcgtaatagcgggaaagaggaagggtaaggtcatagcgcaggccgctgtccaccaggtcattctcctcctttgcctcttccaggttaaacttgtcccctcttttcagtatcttgaaaatcagcttctcattgtccccgccctgtttgctggtcagattctcaatgtgctcaacgcagggtgtctctatctgggtaaatccaaaacttttataggtctctctgatttgattcatcacgtactcacgaatctgcatctcggcaggcgtgatatccctcatgccggtgaccggcttctttgctaatgccatacgcgttctccaatcctgatttttgttcaatatctttattttaagcaacttttatgattttgcaagtgttttcaatgattttcccctattttatggcttccgccgcaatccgcatacgctcatagggcacgcccatgggaatggtgcagtccgtccccaggataaagcctgtttctcctgcctcggatatgacgcgccgtacctcctcacggatttcctccggagtcccttcaatcagcggtcccatgtgattggacaggccgcccatgatggcgcagtccgtaaaccgctttctgccctctgacagactcatccccgtctcataaatgccccagttggctatgctgtaaaggcccttatagctctcgtaccggtcaaaattcacatctgtcttgcacatgtgcaggatattgtggccccctgcttccagacaggcactcattatctgcttatccaggggcatgatatactcggcaaactcctggtcggtaaacaaaaaccgctcccctcccagccctgcatagaggatgccgtccagtcccagttccacaaatttccctgccagcaggcacagaccgtcagcaatccgcttcatggcgtccagcacaggccccttattctgacgcaaatggctgcagagcagctgccgcaccggcatataaccgtaatccggctcaatgggatggatggtggaggccacaatgccgtgaagggtgccgatattaaaggcatccctgtcgcaccggtccaggacgcgcttgaccagctcaatctcatcctccatgaatttgtccttaagggtaatggtcctgatgcatttccagtcctcaggcgtttttatggaacccatgttgggaaccaggttctcgttcatgattttctggatatccggattcacctcgctgaaaaacttcagatgctcctccacggctgcctccccaaaggccgactccctggcaaaatgagtggtaaaataacagggaaccctgtccaccggctcatttctcattgctgcaaatacacgctctctctttttcacaatacctctcctcccagacacttatgattcactgaaataataaaatctgccggaaccatgtctctgtttacatgaccccggcatcatgcgctgcggcaccctgcatatctgtatggaaccgctgcctagcagactcactgcgtaaggatgcgctccttgcgcccaatcatctcgtcaatcctgctgatatactgctccacttcctttacgttctcgcaccgttccctgcggttttcagagggaaataccaccttggtggtggttcccgcgccgcaggcagctatggtctgcatctcctccatgataaggatgttgtagatgcaggctttgccgggcagggaataccccacattctcaaaattaccggccatgtttttctggcggtacagataatacggctccatccccatctcacgggcgcaggcagcgctgagttcaatcatctccggcgtgttctgaatcttcagcccgccgtactcttccctgaacatgttgagcctggccgccctcttaatggccagtgaatggacggtaagggaatccgggccaagggcctttaccttggccaatgtatgccgtacatcctccaggttttcctccggaagccccataatcaggtccatgttaatattgtcaaatcccatctcacgggccatgtaaaaacgttccttcaccatctccacggtatggtggcgtccgatgatgtccagtgttttctggttcatggtctggggattgatggaaatacgggttatcccgtggtttctcagcaccctgagcttgtcctgggtaatgctgtccggccttccggcctccactgtaaattccagtactcggctcaaatcaaacagctgctccagcctgcttaagatggcgtctatatcctccgccggaagggatgtgggggtgccgcctccgatataaaccgtgtccaggggccttcccttcattttcccggccgtatattccagttccttaaacagggcctccagataaagtccggtgcgccccttccattttccaatggggtaggaggtaaaggagcagtaaagacaggtggtggggcagaatggaatccccacatacaggctgtagcccctctcataatccaatggttccaggagccgcttctccctggcggcaatctcaatgctcaaatctatcttttcatcactggcaaggtaagtctccttcataaaggagcgtatgtcctcctccttccagccttcctccagcctggtaagggctatcttggtggggcggatgccggtaagggaaccccagggcatttcccttcccgtacgctccgccagcataaggtaaaacatcttctttaccacattcttggtggcggagtggtctgaaaggtcagaggaacgggtgcaggaagctgatagcccccatccgtccagcccttccggccgggacggagccgtaacctgttccggcccggccccgccctcccggcagttttccggggatgtgccgttctcccatatataaacggaaaccgttccgtctcccagccgtgtctccacatagaagtccgctccgtcctttacctcatgggcataggcctcacctggataaaaggacatcagaagttctctgatgtcctgttcgtactggttatcctgtattaaaagtccaatcatacaaaacctgctttctatataaaaccttccttctattcctgtttgaaggcatccgggccttttacccggagaatgttgtctcttactgcaaacacgggatttccctgcttctcaaatccaatggtagtggggtccccatggcctgtatacaccatggtatcatccggcagattaaagagtatgtccacaatggaactgacaatgcgaatcgtattaccagtgggcaggtccgtccgtccataggagccgcggaacaaggtatcacctgcaaagataatgccttcctccggcagatagaagcagcaggagcctgcggtgtgtcccggtgtgaacagcaccttccatctggtccccagaagttccagctcctgcccgtcatgaagaagcacatccgcatgaaggctggtctgcggtccccggaatcccccggtcatattaagcttggtatcggccagcatattgtcctctgtctcatatgcgtagacctttacccggaatgccctgaccacatccggcacagccatgatatggtcaaaatgtccatgggtcagcagcaccgccgtaagattaatccccagctcactgcacttattcagtatatagggagcgttgtcagccgggtcaatgaccactccctcctttgtattctcatcataaaccaggtagcagttggtactcacctgtcccagtacacatgtcttaatcctgatatcgctcatatccttcccctttcatatctaagctaacctgtcgtcctctctatatccagaacgccctctatctggcgtatcttgtcggtcagccggttcagctcatcggtcccatgaatgtcaaacgtcatgataatggtggccttgccctgcttgctggtccttacgttcatggaggtgatgtcaatctgcttctccgtaaagaccttggatatatccgcaaacatgccaatccggttattggcaaatatcttgatttccgtggaatactgctcgttgctgctggctccctctgccatctgccactccgcgtcaatcatcctgctccgttcatcctccggcagattgatgatgttcacgcagtccgtgcggtggatggacacgcccctgcccctggtgacaaatcctacaatttcatctcccggcacaggattgcagcacttggagaaccgcaccgccaggtcatggattcccttgaccatgatgccgctcttggatttgcggacactggcctcgccggaccttcccgctgtgtcggcaatgccgctgagcacatccgcatccgtaatctccctcttaagcttcttctcccgctcctccatcatcttgttgatgacctggccctctttcaggcccccgtgtccaatggatgccaggacggaatcccagtccttgtaggcataccggttcataaccttttccatgaactccggcttgccgatttcagaccagttaatgcccttggtcttgcagtaccgttcaatctggtcccgtcccctgacgatattatcttccttcatctggctcttgaaccactggtttatcttattcttggcctgggtgctcttcacaatgcccagccagtcccggctgggtcccttggaattctgggaagtgataatctccagctggtcgccgttttgaatcacgtattcaatgggcaccagcttgccgttgaccctggctcccaccatcttattgcccacagcactgtgtatacaatatgcaaagtcaatgggagtagaaccgctgggcagggtctttacatcccctgacggcgtgaagcagtacacactgtcggaaaacaaatccaaatctcccttgaccatactcaggaattccttggaatcgtcggtgtccctctgccactccagaatctgacgcagccagctgagctttgcctcagcgcttcccgcagccacctgtccgcttccgctctccttatacttccagtgggcggcaataccgtattccgctgtcctgtgcatctcataggtgcggatctgtatctcaaagggctgtccgttgctcccaatcagggtggtgtgcagggactggtacatgttctgtttgggcatggctatatagtctttaaaacggcccggtatgggcttatacatctcatggataacacccagggctgcgtagcagtccttcacggtctccaccatgatgcgcactgcaaataaatcatatatctggtccagagtcttgttctggttcaccatctttttatatatgctgaaaaaatgctttacacgtccgcctaccaaggcttcaatgcctgcatcctccatgtggctcctgacctcatccacgatttcctggacaaaggcctcccttgtatccttgcggagggccaccttttccaccaggtcgtaatatacatccggctgaaggaacttaagagacaggtcatccagctcaatcttaatcttggaaatacccagcctgtcagcgatgggagcataaatctccatggtctccctggccttttccttttgcttctccggcttccagtactggccggttctcatgttgtggagacggtccgccagcttgatgatgatgacacggatgtcctttgccatggccagaaacatcttgcgcaggttgtctgcctgtatctccaccttgtccttgtcccagtttaactgcgtcagcttggtgacaccgtccaccaggaaggaaacctcggagccaaactccttggtcagctgctccagggtcatgatggtgtcctccaccacatcatgaagaagccctgccgcaatggtttccttatccatctccaaatcagccagtataatagccacacagagcggatggatgatatagggctccccggatttgcgcttctgctctttatgggcctcatctgcaatcctgtacgccttttcaatcatggtgatatcatcggaaggatgatatttgcggattgtattaatcaagtcctgatacagcacttcagggctggtaaagtcggccggcgcttccaattcgatatccagtttttcttttgttccctcatttgccatatgttcggtcaccttttcctatggatagtcaagatacattataattttttttaggtaaaaaagcaaggggcgcttagaaaaaagcggggccgggccggaacgctgtcactggacacgcgctataccggccctgcctcgtctgacttgtcataaatggcaatcccgtttttctctgtgcgcttcaccctgtacatggccctgtccgcccggttaatcaggtcctccatgctttcggattccctctgggcaaaggccaggccaatggacgcattgattctgcggctggtgccgtccggcagctggatggagctgcgtccctcatatccgtccctgaccttgctctctatggtccttctgtcactgtagccatagaagaacagtacaaactcatcacccgacaggcgcaccgcaatgcactgctccccggatgcaatttcagtcagcaggtctgccatggccctgagataatggtcccccatctcatggccgtaattgtcgttcacatatttcagattatccaaatcacagaaaaccagtgcattgacccggctcctgttgctgtccagtatcttctgcccctccttctttaggtaggatgcattgtacaggccggtcagctggtcgtgctgggatatatttctgagccgcagtatctccatatatgcgtccgtcttgtcaataacaatgccgaacaccccgtgttcctcatgcctctggcgtatggtcacggctctggtattgcccgccctgtcaatataggaatatccgtcctccagctccgccacccggtccagcctgcgtatgatgtcctcccacatggcgtagtccacgcagctgtcggctcccatacgttcctccggaatatccagcagctgcaggatggatgaactcagtttaacccgctccccgcccttctgatattcaaagctccccaccttttcccctgctgattccagggtaaaggagtatctggaatagctctgctccacctttgcagccatatcgttgagggcctgatggatacggtctatctcttcaattccaatatccttaaagtgtacctcatccggattctggcaggtgatgtcctcctgcagcttctgaattggtttcagcaccatccagatggcaatataagagaaaataatggcaatcacaatggacagcaggtatactcccgccaccatgacaatagtggacctggacagctccgccagctccgagtggtagcataccgccgccacatacacggtacccccgttcatgtgaccataaacctggaggacactgcgcacaccgtcataggaagcatcgttataagttaatgatatccggtttccttcctccctgtattcatagtccgtacctatggacgccttatcccggccatagagtatctgcccgtccgtcatgagaaggacttccattcccttgtagggagggttatccagactcagatatgagtccagcatttccccgctgatttggaatcccattatccggcggctgccgtagacctcctggcttatgacataatacagacggttatccccgaaaaaccattttccccctttggtccgttctgcccaataccgctccgcctttgcccagtcctcagatgtgagcttgggactccagtccttagagagggcaatgggatattcactcttggaacttcccaccacacagtagatgtcgccataggcagatgagaatatctgcggctccccgtcccggtatatgacggcctccctgccgtccagattcaggtaaaagacgccgtccaccgacgatgcatggtttaagttatcaatcagtctgtcatgtatctttctgtcatcctttatctttgccagctctttctccatggtattggcgatgagaagggagttattcatatatcctgatataagtgagtttttttccgctacctgggattccattaccttataagggcggttggctgttcccgaaaaggttccggtcaccatcagtccgaaaccaaatataacgctctgcagcaggatagccatcaaaatggcgttccttaccctgttgctcagcaaacgttttttcataggatatcctccattccccaaacagaggcactgtcaggcactattcttcgaatatagcctttacctgttcgtaaaatgcatctgcctttctgccgtaatccatggaagctgcagcttcgtccatggacatcccctgccccagatactcctcaaactccatacgcccccggctcagcgcctcgctgaaacaggcgtccacttcagtcctgacatcataggaattctcaaagtcaaagccatacaccatctggtaggaactgctctgcttaagtccggtttcaatccctttaagcaccctggcatcatcaatctgccgcccctgctcctctgtcattgcgccattgtccacaggcatataggacatggatgtggcaagctcaaaacccctgtcaatggtcagccagtgtatgaaatccagggccgccttgttttcctcatggctgcggttaaacacagccacgcccgccccctgctggattgcagtgggggttgtcccctccatcaccggatattggtagacaccggttgtaaccggtaccatattcccctccgaatcagccacttcctccgggaaatagaggacgctgctggaggaaccgatgcagccggccagataggactgctttacgtcatcgctgcggtagcggccctttgccccataatatcccttggtaaaaggctggtaataattcaggaacagcctttcaatgatatccctgtccaaatccggcaccacaacgccgttctcgtcgtaatggtagatatccgagcccatggcatgattcatggcaacgaaataattggccaggttgtccactccgatgaagggacttccgtccccgtctgtttcaggagtcatatcgtctgtccacctgaaatatccctcagccatcctctccagaccttcccatgactccatgttctcctcccggtaccggggattggcatccagaaatgcatccagcctggtctggttcatgagaagaagctctgtggactttgcaaccggcagtatatagagctttccgtctatatagccctcgttcagatacgcctggttatactgggcaaggtcgctctccggcaccacgcttcccagctccaccagcctgtcgggatgaagctttaccgtgttgaccaccatgtccctgtaggccagcacgatatttgccatctccacatcgttggtggttccgttgagcaccaaatctatcttattggtcaaatctgcaatagaaccctggctgtatgcctccacagccacgccccgttccctgccaagggtatcgttatactcctttatgagctggtccagatgctgcttctgcgcatcgttatagtagtgccagaattcgatggacatgacagtctcactgtcattttcctctgtctgggcagaagatgcctctgcctgggcccgggtgggttccgccttcctgctttccccggaacagccgcccgccagaactgcggctccaatgcaaagggctgttattgacgctatccgtaatcttctcatgcccgtaatcctctgcctttctaaaatttgtcggtacgtttagataattattaatattgtactacggggaaggggtttgttcaaggaaatatcagatgaattttgatatagggcagatggacaggaataacaaaaaggcccgcttttcctatggcaggcccattctgtaaccaaatctatctcatttttctacttaccttcataaataatcgccgaatccacgtcatatcccttcagatgctcccggccattcagccctgccagctccatgacaaagcaaatcttcaccacctggccgcccagctgttcaatcagcttgacaattgcctccgtggttccgcctgtggcaatcaggtcatccacaataaccaccttctggccgggacggatggaatccctgtgcatttcaatggtagcctgtccgtattccaaatcatattccatggcaatggtctcgcagggaagctttccctttttgcggacaggcacaaatcccttgtgctgcgcataggccaccggcactccaaagataaagcctcttgactcaggccctaccaccaggtcgtaatccaggtccttgaccatgtcaatcagactgtccactgccaggtgcagaccgtctgcatcctgcaggatgctggtcacatcccggaatataattccaggctccggaaaatccggtatgcttcttacatactcttccaactttttcatgatgattccctctcttccacattcagattcttaaccgtgtccctgataaccagcttattgttcaggtaaattctccggttgtcgatgattccctcatccaggcgccgaagcagcaccctggccccctccttggcaatctcactcatgttccgttccaccgtggtcagatgcatgtccgaatagccggacatgtcccagttgtcaaaaccaaccagggatacgtcgtccggcaccttaaggccggcctccacaatggctgtcctggccccgaaggccatctcatcgttaaagcacaaaagggctgtgggacggaaggtgaggagctgttttgccgccgtataaccactggcataccggtaattgccgctgataacaggaagcgcatccgggtccagtccgtggctggccatggaggtcctccaccccctgcggcggagccggctggaatccagtcccggatttccttctatgataccgatgttcctgtgtccgttctccagcagataatccatggcccgctccatggcaagggcctcatccgtggtcacattgggcgcatccacatccacggcccggcagataactgccatgggaatctttttgtccaggacctcgttcatgaactccatgtcctcgctccgctgggacaatacaatgattccgtcgaaatagctgggattcagtgttccgggttcatgcatatcaatacctttaaccactacattatacttgcttcccgtaacgctgtaaacccctgtcagcacgtcatggagcacaaagggcgacgtcatcttgctgatggtagaaaaatacagcccgattacataggacctggatttcttcaggttaatggcggcctggtttggcacataccccatctcatgagccaggcgcagtatgttcttcctggtctccgtgttctccacccctatgccgtttaaggccctggataccgtggaataggaaacccccgccatttttgcgatatcctttatcgtcactgccataatatccccctctttgtaatcccccgtaagcatttttgtattcgttccgttcaggcgtacgaatacaatctaactcgttttccggctcctgtcaaatgcttccggagacacggccgatattttccgtgataagggcaggaccatcctgcccctccacctttacatcctcaagaaccagctcatcaatctggttggcgtagattcccatgcggcatatatgggtatcgcatccatccatcatggccggctgtccttccctggcagaagaagcataggtgacgcggacatgttccatctccacccgcccaatccgctgttccggaagtccatacatgtaggccgccgccacatggcagttcccggcctctatatccttaaagcacaggctcttaatcaggggcgtcctgtcatccacgggcagtgctttttttgtgcgcacatattcgctgtgtccgtccgggtcgcagtaataaaaacagttgatgacaaaaggggtcatcacatggtccatacggatgtgttcaaagacaattccgtccaccacggcatcctttcccctgcctctgcgcgtcttgatgcgcagccccctgtccgtgtgcaggaacatgcagtcctttacagtcaggttctttatgcctcctgccatctcgcttccaatggtaacggagccgtggccgtccctcatgcagcatctgcgtatggaaatgtccttagacgggcgtttataggtggagcccatatagatttttcccgactttacggcaatgcagtcatctcccagagaaaaatagactccggcaatctccacatcctcacaggattccgggtccagtccgtctgtgttgggtgaatccttggggttcaatatcttaaggtcaaggaatctcaggtggtctgaaaaatagggatggatgttccagctggggctgttcctcaccgtaattccctgaatgaccatctggcggcaccgttccagaaaaatcattctgggtcggcaggccgtgcgcattgccttgggttcatgccaccagtttcccttctccggccctgcgttcccgtctatgattccctgtccgtaaataacagcatttttcacattaacgccggtaatgatgccggtaaacatgggcaggggattgccctcccatgtacccaggttgtattcaccctgctcatcatagctctgaatcattcccttaaacacaggaaagcgggaccggtccgtatacgcggacagcacggctccctcagccagttctatgttcacatcatcctttaagaacagggacacaatccggtaggttcctgcgggaatcagaacccggctctctttggggcaggccatgatggcggcctggataaacagcgtatcatcctggaccccatccccctttgcaccgaaatcccgcacatccagggttacgaattcacggtccgtggtaaaagaggactctgacacaagtccgtctttacttctggcctccacccggtagctggtgtccggtttcagattatatatactgttgacagccttccctgtctcccggataaattccccgttcagatagagacagtacatccggccggcctcatatgtgcctccgtcttcaatttccagtacagcgcaccgcgcatttttgtatatcaccttcagctccatggcattttacctcttctctcacatgttcgttataattccctgtaaatttccatacacggccgttctgccaaaccaggaatgggggccctccaggagagcccccaaccacatccaggccagtcccggcctttttatattttaacccttaacgccgcctgccgcaataccatcaatgaaagaatcctgagcacagaagaacacaatcagcgacggcacaatggaaatcagcgacatggccaggatacggttccactggaatcccacatctccgtccatggacatgcgcaggtatacggaattggtatatttctgcatgtctgcaatgtaaatcaatggtccctggaagtcattgttggtccacataaactggaacagggcgcaggaaaccagcgacggctttaacataggaacaattacataccacagtgtctttaatgtattgcagccgtctatcttggcagcctcctccagctcctttggaactcccctgaggaactgaatcagcatgaatacaaagtaggtatcggccgcaaacagggacggtactatcagcggaaggtaggtgttgacccatttccaccggttgaacatgatgtactggggcgcattgagaaccacctgcggaaggaacagggtggacatcagcagcgcaaagaaaatcttctttcccttaaaatcaaaccgtccgaacccataggcagctatggtggcggacaccaccgtgaagataaccttgggaatcacgattttatatgtgttaatcagggaggtaataagggatatcttgccgccgtagctcttaaaggcattgttgtatccgtcaaacacaggattcttaggcaggaaccatgcgcttgtgaatatctcggaattggtcttaaaggtagcgccaaccatccatatgagagggtataccatgataaatcccaccagaatcagcagggtgtagcggattgccgtgcttactttttgttttgtctctcttgtcatccgtttctacctcccttcctcgtccgaataataaacccactttttctggctgataaatgccactgcagtcagggtcatgacaatcaggaacagaatccaggcctgtgcgctggccatgcccatcttatggcgcaggaatgcgttgttgtaaatcagcatggaaatcaatgtggttgcaccgttgggtccgccctttgtaaccaggaacggagcgttgaactcctggaacgcctggcagagctgtgtaatcaggttatagaaaataaccggtgtaataaggggcactgtaatcttaaaaaactgggtccatttgcctgcgccgtcaatggaggcagcctcatacaaatcttcggacacgcccttaagggctgccaggaaaatgaccatggcggagccaaactgccaaacgcgtaaaagtacaatcacgaacagcgcgctgttggaaccggccatccagttaatcttcgggcctccgaagaatgtgattaccgtgttaatcagaccatccgtattaaatacagccctccagagaatcgctatggcaatggagccgcccaggatggatgggatgtaatatgctgtcctgaaaaagttcacgcccttcagcttgaagttaagaatatacgcgataaagagggcgaaggccagctttaggggcacgtcgaagatagcatatttaaacgtcaccacaaaggccctgatgatgtcctcatccgtaaatatcttctcatagttcagaagtccggtctttgttattccgttgaacaaatcatagttggtaaagctgtagtacagcgaagatgcaaatggatataccttgaacagaagaaatccaaccagccacggcagaatgtaaagcaggccgatattcagcgcccagaatcctttcttttttttcatacggttacctccaaacctattaatttaaatagctctcatacttctccctgagcagcgtacctgtgctgcaccccttctggataatgtatgccagctgctcatgcgggcccggattttctcctgccagcatggcctttaaccttatgcggaacatgtcctggagcgccctgtaatgctcgtatatttccggggacatctgctctattgtatctatcagcagaaccatctggtccatgccgggcgttttcaaagtcttaaaatatgtaacaatgctgtcgtaattttccctgtgttttactgctttcctgacatccatcttattcctgacaccgccttttcctgataatccgccgcgccttttctgccgcccctctgtctgaggcaggccagggtgcgggccgcccggttcctgtccggcggccctgccttttattccgtaaccattacctgtcctgaagtctcattaatatcagaagttatagcagtcgtcaatacccttcattaaatcttctgctgcctcggcggaactgatgtcgccggcgctcagctttccaaatactttataatatacgctgtccgggttggccttcaggtcgttgtgctcaaacattgggtccagagggaatttggagtaagccagaacctttgcgttggcttccataaccagcttgtcgccgattcccttttcctccagaatctttacaccctctgctgagcatggaatgccccgctccgtgccgcagatttcaattgcctcgtcatcatttaataagtagtcaatgagcatggctgcttcctttggatgggcagaatttgcagatactgccaatgccatggaaatcttggtaaagcctccattgtaatcgccaaaggtaaggaaatctccaataaccagctcctggcccggctttgtggtactctcggcaattgccttctgcaccttggaaactgcggaatcccactcaaacacacctgcgtacttgccgtcgataacctttgcgttcttgtctaaggaatcagccatatctccctgcagggtagcgatggtaggaatcacgtgtgcctcctccagctttgtcataaagtccatgcctgtctgaatctcctcagccgtatactgaagctccccgttttcaacccacggcttgccgtatacgctctccagatagtataccaggaagatggccctgtcatattccatcatggccagagggtagtaatcctcattgtaagccttgaacctggcccctgcctccagaagggatgcctcatctgtaggaatctcacacccgacctcctcaaaggtcgtcttattccagtagaacaggcgtcctgtcagggccaccggcactgccatcagcttgccgtccgccttgcactggtccaggctgtcctgggaaaactgggtcaggtccaggacatcgctgtaatcctccaggtttgcaaagttggttccgttcccgctgtaggatgtaatccagttccagttaatctgcataacatcggctgcattgcctccctggatggccagggactgcttctcttcccatccggtccaggcgccgtactcgcattccaccttaatgttaggatactttgccatgaatgcatccactgccttctcggtcgcctcatgtctggaatcaccgccccaccagcagaacttaatagtcacgtcctcagacccgccctctgcttccttgccttctgcctgtgccgccgtggtggttttgcttccgcttcctgcgcaggctgtcagtgataacgccattacagatgccagggccagtgatactgcttttttcaggtttttcttcatcatttctctccctctcttttctttgtctttgcttgcgttgttgcaaaggtttgcatctatattataaaaattatgcatatctgctatttgtaagctgttacaattcgttaattttaagcaaacatgcatcgtttttctttgtgattttatagtatcactatttataccatatgtcaattgtctgtttcgtatagttttacattattttttcgtgcaaatcatccaattcttttccaactctttttatgataagatagactcatgattaaaaaaatggattttaaagttttcaaggacatattgcactgtaattcacccttgctccaagggaattattatctcaaattactattgttttgtctgcaaacgtttacacttccattttccaaagacgcctctaatcaggctcatgtatgcacatctgtataaaggagagttaacattatgaaaatactggaccgttacatcgaccagctgattgaacagagcacccctgagtcccctgtgtggaacatcgaaaaaatccgggagggttcagactccacctggaactatattgacggctgcatgattaaagccatcctggagctctaccttatgacaaggaacaaacggtatctggactttgcagacaccttcattgattactttgtaagggaggacggttccattaaatcctatgaccccaaggaatacaacctggataatgtaaatgcaggaaaaaccctctttgacctttacaagctgacaggaaaggaaaagtacagaagggctatggatactgtatacagccagttaaaggaacagccccgcacctccaccggaaacttctggcacaagaaaatctatcccaaccagatatggctggacgggctctacatggcccagcccttctatatgcagtatgaggtggagtatgataactgtaaaaactgcgatgattcctaccagcagtttctgcaggtatataaacggatgagggacccgctgaacgggctgtactaccacgcctacgacgattcacgccagatgttctggtgcgataaggtaaccggtttgtcggagaacttctggctccgggccatgggctggtatgccatggcgctcattgacaccatggaggtcatgccggactccatgtccgcacagaaggaacggctgaacgtcatttacagggagctgattgacgccatgcttccttaccaggaccaggccaccggcatgtggtaccaggttgtgaaccgcgggggcatcgcccctaattacctggaggaatccggctccgccatatttgcctacgccatcatgaaaagcgtgcgtctccggtaccttcccggagaatactttaaatacggccaaaaagcatttgaaggcatctgcagcacatatctttccgaaaaagacggcagactccagctgggcggcatctgcctggttgccgggctgggcaacacggacatgcgggagggcacctttgaatattatatgagggagccagttgtggaaaatgaggccaaaggaatcgcaccccttatcctggcctacattgagaccatgttccgctgtcagccataaacagaccgtaaaagtgattgaacccaagggctgttttcagtataataatactggaaacagtctttttcgcatttttctgtttccggaaaggcaaatatatgaatataaaacattttgatattatagtcacggagcaggaatgcggccacgaaagggcctcccatgagccggcggacctgactgcctatctgctggacagcctgccccacaaaccggaacttctccgtccggccatcatcatatgcgccggaggcgggtacggcttcgtgtcccccagggaagaccagccaattgccatggaattcctggcagcgggatgtcaggtgttttccctgcactacagcgttgctccggacacgtttcccgtggccctcatggagctggccaaatccgtggcctttgtaaaaagccatgccggggaatggaatattgacacggagcaggttatggtgtgcggtttttctgcaggaggccatctggccggctgcctgggtatgatgtggaaccgcgaattcctctgcaggcccctgaatattgctccggaggatatacagccaaaaggaatgattctgtgctatccggttgtcacgtccggagaattcgggcaccagcgctcctttgaacagcttctgggcagcagggccggcgaccctgaactcagaagcctggtttccctggagcttcaggcaggcccccagacgcccaggaccttcctgtggcacacctggaccgaccagtccgtgcccgtggaaaactcccttttgctggcccgggccctgcgaaaagccggcgtcagtctggagatgcacctttacccccatggacgccacgggctgtccctggccacggatgaggtttccgacttcacaggcgactgccttgtgccccattgtcagggctggatggaactggtaaaagaatggataaaagaaaaggacagggaatgatatgttaaaagaagaacggcaggcattaatcttaaacaagctccactcctccggcaaggtcgtggttagcaggctggcggtggaactgaatgtatctgaggataccatccgccgcgacctgcttgacctggaccagaaaggccaggtcaaacgggtattcggcggcgccattcccatggagcgcccggtcatcaacttctttgaccgcgagacaacagacgtggaattaaagcagcgcctggcgctgaaggccctggactttctggaaaaagaccagctggtggccattgacggcagcagtaccaacctgcagtttgccaagaacatccccaacggcctgaagctgaccgtgctgaccaacagctattccattgcccatgcctgttccatgaaggaccaggtggacgtgattgtcctgggaggaaggctgttaaaggaatccatgaccaatgtgggggaaacagcagccagccaggcagcgctttaccacccggacctgtgctttatgggcgtatacgcaatccatcccgaatacggcatgaccatcccatatccggatgaggtcagcataaagagacagctgattcagtcctcccggagggtcattgccctggtaaaccccatcaagctgaacaccgtgtccaggtaccatgtgtgcggcatcgaagcctttaccaccctgattacagataacgacgtgtccggggaaatggctgtggattacaggaataaggggctggatttcctataggactgcgattttttgcgttacttttgcggtattttcttctcactccagcacctttctgtgtgctttttaataaaaatcgcatattaacgcacttttttgcaatattttgcttgacatagcatgtatatgcgctataatacacttagagataaaaaggaaacgggcaggagagcctgtcccacacattttaggagggtatttactatgaaattttttgtggacacagctaatgttgaggatattaagaaagccaatgatatgggcgtcatctgcggcgttaccaccaatccatccctgattgcaaaagagggcaggaacttcgccgaagtcatcaaggaaatcaccgatattgtggacggacctatcagcggtgaggttaaggccaccacagtagatgcagagggcatgattaaggaaggccgtgagattgcagccatccatcccaacatggtagttaagattcccatgacagtagaaggcttaaaggctgtaaaggtacttcacgcagagggtatcaagaccaatgttaccctggtgttcacatctgcacaggcccttttagctgcacgggcaggcgcatcctatgtatccccgttccttggccgtctggacgacatctccatgcccggcattgacctgatttacgacatcaccgagattttccagatgcacaacattgaaaccgaaattattgccgccagcgtgcgcaacccgattcacgttattgactgcgccaaggccggtgccgacattgcaaccgttccttacaaggttctggagcagatgacaaagcatcctctgaccgaccagggcattgccaaattccaggctgattataaggctgtgtttggggaataaaaggaattgggacagtgcgaggtttgcagatggcgtgggtgcatccgtccgtgagccaaacaggggcggaggagccggaataactaagatacattccactcacccgctgcgtactatggcatctgcatcgttcatattccaaatcaaaaaagaaaaacggtatgccaggattgacggcataccgatagagataaaggggctgtaaaataagtccctaattaggaaccgccagaaccggaaaatgccagttctggcggttcttggttttcttatcaccacaaggttcgcattcatagagttcttccgttctcccatattggttcttataaacaggccgcttgcatttgaagcagaacctctttccgttcgggcagagcaggcttccagcgtcatcggcaactggatatccgggaaaatgtccatatatttcacggaacttctccatcagtggtacaaagcattccatgtctgatacccctggcagggctgcactgaagtttgacgcgctccctgccggtcattctgcttatttctttattgctgcggatggttcactacacgaatcggcttcccctctaaaaaagctcttacattctctgcgcacatctccattattctctgtctgctctcctttgaagcccaggaaatatgaggtgttatcaagcagttcggcgctttaagaagcggattatccgctctgacaggctctgttgaaacaacatccaccgccgcagctgctaccttccccctggtcagcgcctcagccagatctttttccacaatcagcccgcctctagaattattgataatgatgaccccgtccttcatattgtcaatattttcattacaaataatcccttccgtctctgaaaacagaggacaatgcagcgagataacgtccgaacgttttaacagctccttaagggtcacataagccgcactttccattcctgtcatacttggttcacggtcataggcaatcactttcatccccaacgctttcgcaatttttcctgtagtctggccaattcttccaaatccaataattcccatggtttttccggcaagctcaatcaacgggtaatcccagaagcaccaatccctacagtcagtccattttccttcagccactttctggctgtgatatcctatgtgatgacagagctccagcagcaaagcaatcgcaaactgtcccaccgccatcgtcccgtatgcaggaatatttgacactggaatgttcctctgcttcgcatatttcacatctaccacgttatatcctgttgccagaataccaataaagcgaagctggggacatgagtcaatcacattctttgtcaaaggagttttgtttgtcaaaacaatctgtgctctcccgattcggcttataatctcggcctcgtccgtcacattcgtgcggtcataaacagtgagctcaccacatttttcaagttcctcccaggataggtcgcccggattttctgtataaccgtccagcactacaatttttgtcatattcatgcttcctttcttccataaccactcagcaaatgcaggcaagtccttctccgctattaattaccgaatcttcactccatcgctgaccagctgagcctgcagctttgaaacatccatattgcgcagagatacaccttcttttatggataaagcgcaggctgttcctgctgcctgtccggttgtcgcgcagcagaccatcattctcacggtctggatggcatcatcctcacatgaagcgcaccgtccggctactgcaagattttccagttttttcggcagaatcattctgtagggaagctggaaatgtgcatcatcctttgacacaacctctccgtcaataaacgttgtgaaaacgccgattgtatcatcaaactctgcgtggcctaaaacatctgcccggcagacgctgtactcccccctgattctgcgcgtctcccgaataccaatctgtcccgccatggaacgcagtgtacaattctcaaatcccatctccttcgcgtaatccctcagcacatctactgcccacatgacctgctgacgccccataatctccgcatgggtcaaatcccacacattggtgccgtcaattccattttccaatgtcagattcagacttgtaaattcaccgttaggcgtaagctccttccaggctcctccatcgcggtctacaggccatcggccatcctgttttgcccgtctgaaaggaagcttcaaaccgtgtgtatccggattggttgtttcaggattgctctcaatataattgcggaacatttttgtatccacacccgaaactccaaagaccattgttacaggaagcacctgtccattattgtcttttccctgttcaaagtcagctcctgccctcgccgcaacatcaccgtctccggtggcatctacaatccggtcggcaagaattgcaccacgtccagacttgctctccacaataactccctttaggacatttccctccataacaacatctgttacaaacgcatgcagcaagggacggattccttcctccgcgatccagcagtccagcatatatttatatttttccggattaataaaatttcctgtgccgcggtcatcatgctgggtaccgccgcaggcaaccatacggtcatcaatctcctttgatattccctcagcagtatatgtattctcattaaaataccatgtataagattccacttggccgacggaaagcgctccgccaaagcacccgtatctctcaaccagcatggtctgtgccccgcaacgtgcagctgcaacagctgccgctattcctgccggaccgcttcctacaacaagcacctgtgtttctgcaattaccggtacttctctacttgcacatacaactgttttcattctacttaatctccttttttataaattttaccgcaaatgtcaaaaaataattgtcatgtcctggtatgacagcatctgcgtgctccgatatccaatgtattgtttttgccgaagcttcctggttttcacttttaaaataccctttctgatgggcgtaatgctcctgggtcatcactgcatctcctgcgattagcatatgacctaaatcagtatcaaacaaaagccctgcagaccctacagtatgtcccggcagaccgaccacctcaatttgaggactgattcgcttttccacgccctggagcctcattccgtctaatcccacatcattaattaaggctcggagtcgatcctgttcttttattccgcagcaccatctggcatgaggaaacattccaagcccctcaaaatggtctgtatgtccgtgcgtaacaaaaaccgtatccacctgttccgctttcaaacctgtatggctatccaaaaggcgaatcatttcttccccttcacgaggcggatccaccagaatcacatgcccgctgtcccacaaaaccgtactgctgcaaattcccggacgaagcggtttttcctccgcttcgccccaatagcggtttcggcttacctgaccgatatttaacattttccagctaaccatgtcagtttacctttcttctgtgcaggtcatccaagctgatcctattcttctcatccatgcagacagccacgctcttttcaacctgctccacacttctcattcccagcaatgccgtatttacgaagggattagacagtacaaactgaatcaatgcaggcgcataatcaaaggtattctgcgggtttaccatctggatccacttttgaaaaattccagatgtaagtgtacgcatggtaactatacccatgttttttcgtttacagtattccatgctcccgcacttaaaaaacggatcgtaggggtgttcaaacatcagattatactgaacctgcaccacatcgaacatacctgtatctatcattctgtaaaattcagggttctgacattcaccggtaatacccaggtggcaagtcagcccctgttccttcgctcgaaccatctgacttaccattcctccgtctttcaggagctcatctgtcagctccggtgtgtaatagtcgccatgcacctgcagcaaatccacagaatccatgcgcagcctttttaagctttcttccaaagatttaaacacattcggttcttccgcatacctaaccttagttgccaaaaacaacctatctctttgtattccatccaaagcttcaccgataatccgttcactcatgccgtccccatatccgggtgctgtatcaaaataattaatccccagctcaaaggcccgttttaccgcccttaaaccgcagtcatagtcatctgagttctgcggatcatactcctctacgtaattttttacgccagccggtacaccgccaaagccaatccggctgacccttttcccggtatttcctaaaattgtatatagcatagaccaaatctccttacattgacaatgtctgtgaaccaaattataatatattcatattttttcaaatttactttaacctgatggaggcatcatgaatttccttcaattaaaatatttcctcacaatttgtgactatcagagtatcagcaaagccgctctcaagctgtatatatcccaatcagccctcagccagcaactcatccatatggagcatgagctggatgtacagcttttcaaccgccatggcagtaccctgaccctgacagaagcaggacgccatttctacgaaagctcccacaagatactttttgaatttcaaaacacgcaaaatattatggagtctctgaaagaaaatggaagcaaaacaggaaaaggacatattaccattgctgtaaccaaaacaaaatcctttatgatcctcgtctatctgctccccagcttccaaaaaagatatcctgacattgaaattgaaattgttgaagtcgactccggtgaggtcgaaaagctcatcaataacggctccgtggatctgggcttctgttttggcaactccaccacctctatcatctacgaggaaatttacaaggagcccattctgcttgcaattccgcctcagaccgagctgaagtgtacgcccgcagaaaacagtttctcttttccctctatccattttgacagctttttccaggagccctttattataggtacaaccggatatctacgggatttcaccctggaaatcttcaaaagccacgagaaacctcttaaccttgcactggaaaccgcagttccggctttcgctcatctgcttactgcggcaaatgttggatgcaccttcatcggaaagctatcaacatttatcgaacccatgcacattgacaagccccattactgccttcttgaccctccattttatcaaaaagtatgtattggctaccacaagcagcggtatgtcacaaaacccatgcgctacttcatcagctatgctaaggatgccatgagccttcctcctttcaatttttagaaaacaatgattaaataatgctgcgtaaaataaacttaaccctttacaccgccttcaaccatgccggaaacaattcttttttgcagccccagaaccactaagatcagaggtagggaagagataaccgccgccgcagatatgacatgccacggagtatacgtttccgtttcaaacattgtgagcgcaatcgtcactgttcttgctgctttggactggttcagtacagaggcaaatataaagttattccacactgccaaaaatgtggtaatgctgaccgtaaaaacacctggcatcacaagaggcattataatttttgtaaaaatctcaagtaccgaagcgccgtcaatcatggcgctttcttctatttccatgggtatgctttgaaaatagcctgtcagcagccataccgcggaaggaagttccactgccgacagaaccaacgcaagcccggtctttgtgttcagcattttaagattgctcatcatctgataaatcggattgagcagtgtaaccggaggcagcagtgaaaccgtcaaaatcagtataagaatcagcttttttcctctaatttggattcgagccagagaataactggccattgaggatgcgattaccaccagcagcgtagctattacgacaacagatacactgtttaccaaatactccccaaaaggctgcgccctaaaaacatccctgtaattgtccagagaaatcttatctgggaaaaaaacagagggcactgcaaacaattctctcatggatttaaatgatcctaaagcaagccagaaaaaaggaaatgcaatcgcaataatgaaaaccaccgtaaatataccagtgccgatacttcctattttttgtttcacgacctacacctccaatttcgatctcatgccatcataaaacaggaatgcaattccaagggatactacaaatgttattacagctagcgttgagccatatccgtaattaccaaaggaaaaatactgctgcatcgtatacatcgtcagacttgtagtcgctgttcccggacctccatttgtcagcaccttaatcagatcatatatgcgaaagctggagattgtcctgaacatgatagccactaaaagcacctggcgaatactgggtatggtaatatagaaaaactgctttatctttccagcgccgtcaatggatgctgcctcataatattccagaggaaccatttttaatcccgacagcatcaaaagccccatatacggcgtcgtcttccatacatccgcaataataacggaccaaaatggggttccccttccggtaatccacgatgccggcggaagtccgagcatttctaggatttgattgatgattccgtatgactcggcaaacatataggaccacataagtccagaaacgattgtgggaatacaccagggtacaaggattgatccgcacacaatggacttcccgcgaaattcccgattcatgattagtgcgcacaccattccaataatcgtttcaagcaccacggaaatcagtgtgaaaaacacagtaaaacgcagtgactgccacatattcccatcagacagtacttttttataatttgcaagcccaacccatttaccgccggttgcaatgttctgaacacgcagagaataaaagcttgtcttcaacgtattcagaacaggatatgcaacaaagacaagaaataaaatcagagacggtatcaagaagagatatcccattataattcttttcctttttttcattatctatcttcactcccttttctttcttcatccccggcggttatgagttgtacccgcataccgcatttaggtcagaatcctttaacggctgtaaatctccgcttctgtctcctgaagttcatcaaacactgcatcaagttctccttcgccagtcagaaccttggttacagcctgttgaagcccggctgaaacctcttcatagtaagcggagcccggacggttgcggcaggactttgcgtaattgattagttccgccatgtccggtacttccttaatcatttcaggattttcatatacagaagcacgtgcaggcatttttccacccatcaaagcgcctttcagcatggcatcctcacttgtccagtaacgaacaagcagctttgcctcctctttatgactggaaaatgctgaaataccaatgttccagcctccgttacagttatactgcatcatatcaggtgtacctgccggaagttctgctaccttcactttaccagctacagaagactgctccgggtcgttcgctgctgccagtgctgccgaccagtctcttatatataaaacctgtcctgcaaagaacgcagcctttacatccttagacatcattcccaaaattccgtctatcgcaacattttcatctaagattttcttcattgatgctactccggcttttacctcttctgtattaaatgtaggctgtccagcctcatccagaacgcttccgccataattccagatatgctccaatgcgcagcaggttaatgcttctgcattctgccatgcggctgcgtatccgtatactcctggttccccggccattacaatcttgctctgttcaattaactcatcccaggtctttgccggttcaaatccgtacttttccaaaaggtctgcccgataaagcatagctcccgtatttaaaaaggtgggcatacacaccagagagccattaacacggcagccatccaaagctccctgtgtaaaatcttttaactcttcttcggtataaatgtcatccaacggctccagccatccggctgatgcaaacatttccggccaggtacagtcaatcaaaaaagcatccatgctgtcatcctttgcctgtaaaaccgtacttagagtgcggacacgatcagaagagccggccggcatttccacaacctcaactgtaatccacggatacagctcctcaaaagcttccacctttgcctcattcgctccatttgtagcggaatcagaataaagtgtaatggtaacaggtttatgctcctcctgtgcctgcgttgccgcttcatccttctcttctgctgctgtctgggctgccgcctctgtttttgcctcaatcggcgcctgcgctgaagaacatccggcaagtgctgtcatacataccatactgacggctgtgaccactgataacgtttttttcattataactgacctcctattaagcagtttattaccccagaataattcaggacgaagagcatctcatcctgtcattcctagcggttatggcattattatattccgatgaacaccttaatgcaaattcgatatctcgatattactattagcaaaatctaatagtagcttctgtctgtccacgaaaaaaaaagaaagagaatctcttgaaattcaagaacattctctttcttaaacttaaccgcattagaggcttcgcgtatgattgcggataaaagcatctccgcaggcacgctctgtttaatggcaccagaactgctgtcctcactgcaacaaaaggtgtacgggttacgaccatgcagcatctcgaatcaagattaggagaggattggaccggagaggtatccttgtcaaaatcgaagcatccacaaaccgtattacatgctcagaacacagtattggtactgctgctgttccatgggcttatcctttacctatgtatcttcttcctccgtaatcagtatcgcctcccccaattcaaacaccttggaaaaggcatacttattcttcttggatgtatccatcaatacataaaccacctttgaatggtctttgacaattacctttttcctggcctccctgtcatcataggtgtagatgcctccgtccggaatatatccgttggcgccaatgaacgccttatcaaaatacatgtcggatatcatcttttccgtcagggcgcccagtacggattccaaatcatccctcacctctccccccagcaggatacactttgcgttcttgatgggcagattgtccagcagctccgtactgctggaaacaatggtgattcgttttccctggagatatttgagcatccccaccgtggtggtgcctgaatccacataaacgcagtctccgtcctccaccagggcggccgccttcctggcaatgacctccttttcctcgctgtgaatcagttttttcttgaccacaggttcgtcgaagtcctccaccttatatttaaccgcgcctccgcgcatcacaatgacgctgccctcctgttccagagcagcaacatccctgcgcacagtggacagcgaaatgccaagttctgccgccaggtcttttatataagagatgtccctctttttaatgcttttcagtatctcttcttttctcaactcaggaaccatatgcttaccccgttgtttcaatccatgcacattttgccgaactgtaatactcctattataccaaagggcctgtccttagttcaaccatattttttgcattttctgtcatattttttcacttttgtccatgggcaggctgcaaacaggattcagacaccgggaaccaggctttcatctatctcgtttaaacagggcatggcctcctgggctcctatctttgtcacagttacggaggctgccctggctgcaaagcagcaggcccggcggtccgtcatacctttatatttcccataggcaaatgctcctatataggagtcccctgccccggtgctctccgtcacatgctccacctttacgggttcaatggataccgtttcttccttacccaacagcatgctgcccttggaacccagggtgacaatgacagtaccctctgtcagctggctcagcctgtctgcatgggccctgaccatttccccatccgttatgtctactccggcgtaaaaggacgcctctgtctcattgactatcaggcagtccaccagcttaagcacttccctgtccaattccttggccggagcagcattcagtatggtgtatacatgatactgttttgccttgcggataatatgctccaccacattggtgggaatctcaagctggagaatgatgattctgctgttcctgaccagttcatccaatccgtctatttccctggccgtgatatcaaaattggcgcctgtgatgatggaagcatacacagtcccatcctccagggcgtggaccacgcccactcccgtggggctgctgctcctgccgatgcaggaacagtccacgccgtaatctcttaacttttccaccagtgtatcgccaaaggaatccctccccaccttgccgaccataatggtatcaattcccagtttggcgcactgcactgcctggttggcgccctttcctcctccggaataggttatgctgtcagccgtgtatgtctcccctaaaaaaggcatacgcttctgcttcatgataatatcatagttaaggctgccgataacacaaatgtaatctctcttgcaatctctcattgttgccacccccacatgcggttattctgcctttgcctttttattcagtctcatggctgccagtttttcctggattacatccacgtataccgcaaatactatgataagacctgtggcgatatactgccagaatgtatccacaccgcagaccaccagccccaccttaagggcctggagaaggattgcacccagaaacgtgcctatgatgctgcccttaccgccggccaggctggtgcctccgatggccgccgccgcaatggcattggtttcgtagctggctcctgcagccggctcgccggttcccagctttgccagcatgaccattcctgcaaaagcaacgcagacaccgcagatagcataggccatgattttattgaagtccacattgacgcctgacaggcgcgtggcctcctcattgctcccaatggagtacagataggtgccgaacttcgtgtgcttcagcaggatataggctgccacggtcacaatcaggaacagaatcatggatgaagacagggtgccgattacatcgccgtccatgatatccctgaagttctggggaatgttaagcacaggccatcctcccgttatcaggtaggcaacgcctctgtacacagacatcatgcccagggttgccacaaaaggctgcagcttcatcttagccacaaggattccattgacaagccccagtacaaaccctatggctgcgcctgcaaatacagccgcaaagggattcagtcccatgaccaggaaattacccacgcttacaattacaatagccagtgtggagcccactgtcaagtcgattccggccgtaatgatgaccagggtcataccaatggccagaaggccgttgataacggactggtccaggatatcaagcaggttggacggcgaaaagtaaatgggctgtatgaccccaaacaccaccatgattacagccagcgcagcaactacttctaattcccttgaaaacttcttaatcatattcttcatagtcagcctcccatcgcaaaactcattatgacttcttcattcagttcgtcatggttcagaaatcccatgatttttccttccctcatgaccacgaccctgtcgctcatgccaatcacctccggcagctctgaggacaccatgataatggcctttcctcctgctaccagctcctccatcaggcggtagatttccgccttggcccccacgtcgataccctttgtgggctcgtcaaatataatgatatcggcatccgtggccatccactttgcgataatgactttctgggcatttccgccgctcaggctctctgtcaggtaatccggatccgccgggtgcaggttcatttccccggtgtaatacatacaattgtcgtatattttcctggcgttcacaaagcctctggtgcagaaacggttcatggaagccagggccatgttgcgggcatttgtaaagttttttacaaagccctgggtcttcctgttctcaggtatcagccccagactgtaccgaagggcatccttcggactcctaatgtccgcctttttaccttttatgtaaacttccccgctggtataggggtcagcgccgaatatggcgcgcatcacatctgttctcttggaacccaccagccctgcaaaggataaaatctcgcccctgtggagttcaaagcttatgtgttcaaacacgccgtttctgcacaggtccctgacctccagcaccacctcccgggaagcgcacagcggattgttccttacagcataggcggacacgtctctccctaccatgtggcgtatcagctcttccttggatgtctccttcatgttcagggtggtgatgtatcttccgtcacgcaggatactggccctgtccgcaatggcgaacacctcatccagacggtgggtgatgtataaaatagtgatgccctgggccttcagctccataatcatcttaagcaggcggtccacctcacggtctgtcagggcagaggtgggctcgtcaaaggaaatgattctggcattgtggaacagggccttggcaatcaatatcatctgcatctcaccggtgcttagggagttcacccggtccctgctccggaacttgcatcccagcttttccagaatgacatccgtcttcctgtacatggcgtcatagtccaccaggaatcccctggtcacctcatagccaagggcgatattctgcccaaccgtcagctccgtcacaaggtttacctcctgatgcaccttggcaatgccaaattcaatggcatcattggcattcttaaagtccacctttcccccgtcaatctccacgcatccatcatactccgggtatatgccgtgaaggatattgagaagggtggatttacctgcgccgttttcccccagaagggcgtgtatctcccctttgtccactgtaaaatccacattgtccagcgccttattgccggggaactgctttgttatattggaaaaatgtatcattgtcgccatattttatcccctctttgaaatatcagccaggggtttgaccctctggctgatgatggttaccatgctgtctttgtctattttgcgtatacagggtcggtccagccaatgatttcttctgccggtttgtccacgttttcagcatcaatcagggcctggggcgtccaaagcactcttggaatctcctgtccgcccaggcttctgagcattacctcgcctgcaatctgggccttatagaacgggaaggagtcaatggttgcgtccagctcacccctgcggatggaatcataggcctctccaatgccgtcaacgccaaccaccaatatatccttgccggaggacttcactgcctccaccacgcccaaagccatggtgtcgttgttgcagaaaatagcattcaggtccggatactgtttaatccatgtatctgccaggtccttggacttctggcggtcccagtcagcattctgttttgccacaatctcaatgtcctttgcattggccgccatccagttttcaaagccctctgtcctctgtcttgccgcaaacgccttaggcattccgataacaatggccaccttgcccttgcctcccagcttattggcaatccactccgccgccagttccccgttctggtccgccttgggtcctacgaaggaatccgcgttggcaatcagtccgtcgtttacattgataaccgggataccggctttctttgcatcctccacgccaggcgtcaggtttccgtcggaaataggagaaaggagcagtcctgtgtacttcttattaatcatatcttttacaatggaaagctgtccctgttcatcgttctcgccctgggcagaagtcacgtctatggtaatgttataaccggctgctgacgccttggtctggtattcgccgtacccctcccgcagtgtcctccagtactcattgtcaaaggattttgccactgcgcccagcttgacttcgccgtccagcttcggaacatcccccagcttctccctcagttcctcgatgctgacgcctgcctccttgtccggattaaaggtgtctgccgctgcctctgtctgggccgtggaggctgcctgcttattcgtacatcctgccatgattcccgccgccatggcaattgctgtcatggataaaaccaaacctctttttttcatcttttcttctccttttacattaaaatagtttttgtttataggaaagcaaccatcatgttgctcacagctactgcgtcattctgttccactaccttctccatccggcagagcccataggtgtcaatgagctgctcaatccgccggcacatctttatatttgcctcgcattcctccactgccttctcccgtttggggaatgtgtcaaaatatatcacgccctggaaatcgtatttcttaaggtagtacatgacctccactgtcttccagaaattaacggttcccaccataaggccgtcgtccgtggagccctcaccgtcattgaggtgaatattataaagctttccccgttccagcagccaggccgctgcaaatgcaggattttccttcttcatcagcatatggcagaagtccagggtaacgcccaggttctccctgtccacgtcatggaggatggaaaccgctgtcccaaagctgtcaatgaatgcatgcaccctttcctcatagggcttatactcaatgctcacaggcaccccggaataatcgcacacatcccggaacgccttcacaatccggttccagtagctcacataatcaatctgaaaggaataatcaaaaccgtcaaaccccagccagataatcatctggttcccccccagcttcctgcatgcgtccgccgcttccctgcacagggttatggcgtcctgggatatggctggttcccggtttccaaattcacctcctatgtacttgtccctgaatctgaggttgatggcgttgcaccgcagtccgcagtcctccatcttcgcctttatcacctctatatcatagtcagcaaaatgttccggataattcaaatccacatagtccacgccctcaatggctcctatggacctgaatgcattcagcaggttgctgtcaaatctcaaaaatgagttaatccgtgtggcatacttcatatgattgctacctccttgtagcttcataatagcatttgtttcaaattatgtcaatacttttcaaattattttatttcattttttggcactagtttctatattttttcatttgcattcagacgcatacagcattttttgtttgtacggggtggttttcatggtttttcaggtagttttaactaattatatgactcttttctgcgttttaatggaattcggcttttctctatgtgccatattttttcatttattttcatttcactgttatccatggttatccgggggcatccggtcataaaatgataaatgccgcagaaaacagctggactcccagcatctttctgcggcatttattgccctcttactaaatctccaattaaattccaaaggtttcaaagagctgtttacggtactccctgtcctttgaggctctttccaaatcatcataccgtttctcagccatgagcagcaggttcagcctgctgacccgctcttcaccttctttttctccttcctcttttccctcttttctgccgtcctcaatcaactcatcaattgccctacacacatccatcccctccttctcaccttgattttccattatagcagccagtcttttctgctctcccagcagcgccagaagggcattggcctcattccggttcagcctgccaagtgcgtcgcgattttctttcacatactcatacagcctctttttatctgaattatattttatcatactgaatatctgctgtaaacatatgaagaatacactcagattctccatgttttggggattaatcttataattgggtataaagtcccgtatagccccgacctcctccaaacagttgtcaaatctcaacatctggtgaaggccacataaaaatgaagcttgctatttatataatttgtattaccactttatatttttatatatttaataaaaatataaaaatattattgactaatatcccccccgtgtattatacttataacaaagtttaaaccgatattttcacacacaaaaggagcggaacggtatgagaatcaaattaaaagagggtataataatagcaatggcattatccttgtgcatgccactccatgcagctgccgcacagggagggtataccgaatcttttcaggaggaaaacaaggataccgaagctatctgcatcattgatatgacagaaaaagtctataactcgctaacaagaatgccaagcgtcgtggatggcaaaacacaagttatggctttttctgttgaaaacctcaagagcaattcttatgtagatggttatgactatggaaaatcactcaatcccggtacaagacaaacatattatgtggtttgcactgcaagaagctccggaaccactgctgatgttggtttggcatactataatagtaagggaaaatatattatcaacagcaaaacatccttaagtggatatgatagctacgggacagtttccgcgacaccaacatttaaaaattacggatacgtaaaaaatactggctcagctaagcttaccgcatcatatgtatacatgaaataaaggaaaacccctaataactatcggcttaaattttataagggagcatctcaactatgaaattaaaatgcagcattgttatattggccggttctttctggactttgggtattccttataaaacattagctggtatcggttcgaagtagatactctcgtatctactttttcttgtaatacccaaagtccagaaagaacccaatagtatcctgacttcttttatattatagtttcatgcttggattcactgcccaaaaccgggcggaaaatcagataattgcttcttgccagacggcacaggatgaaatcctggtgaatgatgaatcagcataccatttaaacaatgcatgcctatgatatggtttaaatctgatgagtggtgatagcctcctatattgaccaactatcatctggtagaattactatatcataatccctgtgaacgtgcaaggcaatgatatgctgcttatcctgaagcagcacaaaccgaaactgtacaggcttgaccccatatcacattgcctatactcagcacaatgagcaccgtcacagaaaaaaaaggagcctgacttccagggccccgctgcatccaactgccatgcaatggggcctgaatcatccggctccctgtttgtattattcttccagattctggaataccgtcttaagtgcaggatacatctgcctgaacttgccgtactgcttttcatactttccggccaggtcagcatccggctcaatggtctctatgacttttacaatgctgtccgctgcggtcttcacgtccggatactccccgcagcccacggctgccagtatggcgcctcccagggcagggccttcctcgttttcaaccacatccaccttcacattcatgatgttggccaccatcttcttccacagagggctctttgctcccccgccgcagattttggttcggtcgattcggatgcctaaacttcttgccacctccagagaatccctgagtccgaataccacgccttccaatacggcctgggtcatctcctctctgctggtatccatggtcatgccgatgaaacatgccctggcccttgggtcgttatgaggagaacgctctcccatgagatagggcagatagaacacatggttctctcccagtttcacgattccctcctgctccctggagaattcctttgtcttaaggatttcctccatccaccacttattacaggaggcagcgcttaacatacatcccatgagatggaaatgcccgtctgcatggtcaaaggaatgaagtgcattgttgcagtccaccttaaagctttcgctggaaataaagatggttccgctggttcccagggaaatattgcagcatccctccccaacggttccggtgcctacggcagcagccgcattgtctcctgctccggcaataattttcacgttctgtgaaaatcccagctcttctgccagttctgccttcagatttcccaccacctgatagctctcatacaaatccggaagctgttccctggtgataccgcacagctccatcatctcatcagaccagcacttatgggccacatccagaagcagcatgccggaggcatcggagtaatccgtacagaaactgcctgacagcctgtaagccagataatccttgggaagcataattttacatatacgggcaaagttctccggttcattcttcttcatccacagaatctttggggctgtaaagccggtaaatgcaatattggccgtgtaagcggacagcttatccttgccaatggtctggttcaggtaatctgtctccttctcggaccgtccgtcattccagaggatggccgggcgaatgacttcatccgccgcatccagcgtcacaaggccgtgcatctggcctccgaaactgatacctgccacctgtgatttatcgcactccgaagtcagctccttcatgccgtccacggaggctgcgaaccagtcctccgggttctgctccgaccatgcaggatgggggaaatacagagggtactcccgtgaaaccaccttgtggattcgtccgcttccatccattaataataattttactgctgaggttcccaggtccactcctatgtaaagcatatctttccctccctgcatttttatgcaaatggattctctgtcttatatcttacgctctttggctggttgtagccgatttcctccacatccacgccaatatacttaaatacctcaaataatgccttgccgtagtttccaaaagcaactgctccgtgatgcggatagttcttctcgatgagcacatggcggtagaagcgtcccatctccgggatagcgaacacgccgatggagccaaaggaacgggttgcaaccggaagcacctctccctgtgcaatgtaagctctcagcttgttgtctgctgtgctctggagacggtagaaggtaatgctgcccggttttatatctccttccagggttccctgggtcacttcgattggaagagccctggccataatcatctggtatttcatctcacagaaagacagctttccggaagctgtgttaccgcagtggaagcccatgaatgtatccttaagcgtgtaatcatatttgcccttgatatcagcctcatacatatccttgggaaccgtgttgttgatgtccagaagagtaactgtatcctggctgataactgtaccgatgtattcgctgagggctccgtagatatccacctcgcaggacaccgggattccctgtgatgtcagacggctgttcacatagcagggcacgaaaccaaactgtgtctggaatgcgggccagcattttccggcaatagccacatacttgcggtagcccttgtgctcttccacccaatcctttaaggtcagctcatactgggccagcttggaaagtatctcaggctttttattgcctgctcccagctcttcctccatctccttcacaatacctggaatacgctcatctcctgcatgcttgttaaatgcctcgaacaaatccagctcggaattctcctcaatctccacgcccaggttgtaaagctgcttgattggcgcattgcaggccaggaaattcagcggccttggaccgaagctgatgattttgagctcgcctaatgcagccactgcacgggcaatgggcacaaattcatgaatcatatccgcgaggtcctctgcatcccctaccggatactccggaatatatgccttgatgttgcgcagcgccagattatagctggcattgagcataccgcagtatgcatcgccgcggccctggcacagattatcgccggactcctcagccgctgccacgaacatcttaggtccgtcaaaatgctttgccagcagggtttctgatatctcaggaccaaaattgcccaggtatacgcacagggcgttgcagcctgccttcttgatgtcctccaatgcctgcatcatatgtatctcgctctccacgatgcataccggacattcatatatttctgctgcgtcatatttagccttgtaggcttccactaatgcttttcttctgttgacagaaagagactccgggaaacagtccctgctcactgccacgattccgatttttacttctggtgtattgttcattgtattatcctcctcatacatgattgattttattgtctgcatctgaaaattgtgttctgttatctgcatcacacgctcaggttctcaccctttaggccgataaacgctccctccggcagcccgccctctgcatgtccgatgagccacttgttcctggcaaataaaagcctgtcctcagggtcctttacttccaccggctccatgtccaggttggtgtctttcggaaggacaattacacatcggaagccctcatcctttacatggcagggtgcatagtgcagggtggttgcatatacctccacggctgttcctgccggaaccagaaatgcctccattctggatgtgtcgtatgtgtggtcctcctcaatatcctgctgttttcccaatatcagaatcaggtcgtccacagcaatgtccacttctgaatcccggtgatattccactgcattcagtttcttgttatgtccgttgcagcatcctatctggatgggcatctggccgtagattccatttcccagctcctttgccgcaggcagggcctccatctcaggcagtgagggtatgtaaataacgtcctcaggtaaaggcgtttgttccattgcctttagcagaccgctgaaatcataacctgtgatgacccttccataggctttaaatgccgaatccgtcacctttttgactgtcatccccatgttcatacctccttgtatcgggccgtgcgtttctccatgtgcaccggcctgttttctctggtatttattataatataaacggacaaaaaaaacgtgctgttattttacgaactaacagcacttttttgcgatttttatgggttcgcctgtttctggttcatctgcttccggttcatctgcttccggtactgactgggcaggcagccataccgctttttaaaggctttggcaaatgcccttgcgtccgcaaatccgtggtccagggcaatgtcccccacataacggtctgaattcagcagttcccgcatagcatacttcacccttaagtccatcaggtatgtgcggtaccccacctgggcatattccctgaacatatgtgaaagataagacggcgtaaagccgaacctggatgcaaccatttccaggctcaattccttgtcataattctccttcatgtattgggttacctgggacagcttgtccaaatgccgcttttgctgtacctggaccttatcaatctgcgcaatcctgaattccgtcacaatcagataaaggaactccataaactggctcttcaccttcaggcgatagccgaatcccctctgctcatacgtgcggtacatggcaatgaccagggacacaagcctggccctctggttctcatccctatccgcaaaggtaatgcaggactcgtcactcatatatccttcaaaggatttcattggaatctggagtacaatggtaatgttggggtcgggacactcaatggaatggatttcattgggattcacaatgacaaaatcattggggttcaatgtatattgtcttgaattgatgtagaagtccagctttccctccaacacaagaaacagttccacagactggtgccaatgcttgctgaccctgtaattcccatcccttccctcaaatatgaacatccgaaagggcaaatcatcattgggaatcactgtctcatatctgaaatccatcctgcacctccccgcttatcctgttatcatacatatgtaatgatatcaaatcactgaatacataaaagtatagcaaaaataatcaaaaacagcaatatcatgccaggattctcctgcagtccggcattcatctcttccattgacaaaaaggcgcggaaacagggtatacccgctttcacgccgaactgttttcccttattcactttcatctgctcagacatctctgtccagcttaaaaatcaccatggtagcagtcccttcctggccggtggtagggctgttaaaatacaaagacagcgtggtggtttcaggtacctcaatgatgaatgatactgccccgaacgcagtggttctttctgttcccgtcttaaaatagataccgtattccaggtgtgcccttccattgtatgcaggggttatctgcatataactaatgtccaccagtatggcagacacctgataggatatggcgtagtatcctggcataagggtaatgtgggttgcgtcagtcaggacaatattcccggtagtgtcttccaccccttctcccattggaatcggaataccattattccacaaaccgccaaaattgataaacgacgcgaatacgcctccagctgccgggcccgttggcccggttactcctgtgggacctgtggctcctgtgggacctgtggctcccgctggtcctgtggaccctggctggccgttttctcctgctggtcccggtactccctgtgggcctgtggctcccgtgggtcctgtgacccccgccgggcctgcggctcctgtcggtcctgtggctcccgccgggcctgcggctcccgtggctcctgtcactcccgttggtcctgtcactcccgccgggcctgcggctcctgtcggtcccgccgctcccgccgggccggtcatcccccgcgggccggttgctcccatggggccctgaattcctgctgccccggggattccctggggtccaacagctcccggattcccctgaagtccctgcgggccctgggggcctgttggtcctatgactccctggattccctgaggcccctggattcccaccggcccttgcggaccggttggtccggttactccggccggtccctgcacaccggtttctcctctgggaccttcaggccccattactccgcgcggacctgtatctccttttgggccagcgggtcccggatttccctggggcccctgaattcccatggggccctgcgcccctgtgggcccggctgcaccggccggcccctgaggaccggtttccccccggggaccttccggccccatggcgccgcgcagaccggtatctcccttcggtccggcagggcctgtatctccttttggtccggcaggtcccgtatttccctgcgggccggcggctccctgcggacctgttaagccccgttctcccggtatcccctgcgggccctgaggtcctgcagcgccgcttattcccggggctcccatgggaccccttgggccagcagggccggtatctcctttgggaccagccggtcccgcaggtcccggacagcagcagcactccttataccagcatccggccctctccctgaaatcctcctgattaccatcccacattttggttcccccttctgcatatattctgtataaatccattactatcaatatatgcatctgtaccgcactgtttccggggtctttatatcagcagtttcctggccacacatactttaaatattccctggcggtctgcaccagggcatataccctggccacatctgttgcaggtctgtcatccatatgccagcgcgggaaaaacctggagacatgaagaggaataccggagttcagggatgatatccaacccgccatctccctcatttccttctctgaatcattttccccgggtacaataaggacggtcagctctacatgacatgcacggctggcacgctctataaaatgctttacagtcccaaggtctccgcccagtttcctgtaataatgctctgtaaaaccttttaaatcaatgttcatggcatctgccaccggcaggatttcatccagtacctggtccgatacgcttccgttggtgacaattacatttttcatccctgcatttctcacaaggcgccctgtgtccctgacatactcccagcccaccagtggttcgttataggtaaaggcaatgcctatattccccctttttctcagctccagggcctttcccgccagttcctcaggattcacggacaatgcatgggcgtctgcctcccctgccatggatatctcgtgattctggcagaaaggacacctcagattgcacccgaagcttcccaccgacaatatggctgaaccaggcatgaaccgcttcagcggctttttctctatggggtccagtgccatggacgtaattttcccgtaattaacagaaatcaccgctcccccggtattcttcctggccctgcagataccggtctgcccatcttccaggctgcaccggttcatacatcccccgcacacagccctcatgactttgcaccatggcggattacctcaaaccgctccagctccacacctgtttcctcctcacggattcccgccttgcgtttggcaatggacacctgctccttcaccgtgtccactccctccagattgggaagcagaagcccccgcttcctgcccctggtgacaataaccccgtaacgcctggggtccagctggtcctcaccctgaaccggctctgtttcccccagcacatccacactgtattccaataagggcagctcttcttccctgacagccgggaacctggggtcatgaatacctgcgctcaccgcattctgaatgatttcttcggcaatgttcctgcataccggcgatatggtcccaatgcatccccgcaaagcgcctcccttatggatggatacaaaaacgcctgccctggtccggagcatttcttccggcagccctgcctctgtcccggcaaagggaatcatcctcccctcatatacataatactccagtgacctgcgggcaagggatacataatcgtcctctgccatctgccgtcttttacacgcttccttctggcatctctcatatgcttccaggaatctgcggccttcgtcctcccctgttacacggaacgtacaaatgccgtatcccactccaaagggaccctcataagtcagacgcctggacacaaccgcctttccatccatggcaccggccatcatggtaaaactgcggtggccgcattcccccgccttttcacagaagtcttccggaaatgtcagaagctccccaaatgcgccttttcccatgacgtccataatccgctcatcatattccggtccctggacgctgtagccataaggcccgtcccctctcagcttatgggacaaatccccgctggccacaatgaatacgctgcgccccagactttccgctgccctggcaatatactgccctgcccggtaatggtccgcaaagggcagtccggagccgccgatacgcaccagcttataatccctgtaatactggttgataaaaaacaggggaaccagcgttccgtggtccagctccttctccttctccccctctgtgcccatgggaaaatccgcctcctcacagagttgttccagctcccttacaaaggcctcatcatacatgacttctgccgaagcctgaggagccataaacggcccgaaatcccctctggccccctttcccggtgatacatgaaaatagtccccatacatcactgcatgaggtgaaatcaccacaatggtctccggttccagctctgccgccatcctggcagccttccggtatgcttcaatggtttccttaatcagaacctcctgccccctgcccacatccggcacgatgagaggcggatggggcaccatgattcctgcaatcacagccataatacttctccttttctgtccggcacgcttcaccggcccgggacgtgccataaaaatcatttctgacaccggcacgctctattaccagttctgattttagtatagcatcggtaatcccattttaaaaggggataacccacaaagccagtacaagcagcactgccaggaacagcaggctgacccctgtgaaccaacccagataccgtcccttttccatgggatacatgcgggcaatatatttatacgagattaggctggccatggatgcgatgagggtcccaagccctcccagattcgttcccacaatcagcgccctgtaatcctgtgaaaatccggacagcagcagtgcggcaggcacattgctgataatctggctggcccccacacaggtaatgatttccctgcctcccagaatgtggtccaggaaccggcagaaagccggtacccttcccatattgccgatgaatatgaaaaaggcgcagaaggtcaggagaagggaataatccactgccagaaacaggcccctgtcggcaaaccatgccactgcaattacaacagccagcaggaccggccagggaagaatatgggccacacagcccaggcatagcagaaagaggaacagatacagccccagacgccccaattgaatccccgttccggccccgtccatactcactgcttcctcggaaagtccgggaaaaccgctgaccatggggccctgtcccctgccgtccgcctcttttcccggcattctgtttctcaatcccaccacggccaggcatagccccagcattacaaaggatgccgctgtatagggggccatcagattcaggaactggcctgcacttaaaccggcttttgaatacagatacaggttctgtggatttcccaccggcgtcagcatgctgcccaggttggctgcaatggtctgaagcaccaccacgggcagcaccagcggctccattcccgccattttaagaaccgtgatggcaaagggcacaaaagtaatcagcgccacatcattggtaatagccatgctgaagaaaaaacagagaaataccagcacggacgacacagcccccggcccttttacatatcccagcagccgctctcctgttttcttaaacacgcccaggctttgaagtcctgccatcacggtcatcaggcagaacaggagactgattgtgctgtaatcaatataggatgcatattccctgtccggccttatgaccagggcagacaaaagcgccaatatggaagctccgctcaggacagtctccctcttaataaatctttttatccttttcatctctatcatctctcaacccccgctttacgttcataatcccacgacagcctactataccatcggaaagccccggaatcaatacaaaatctgtacaaatacagatgtttttcagcccgctgttttaccgtaccgctgattgtatcatggcatggaaaaaagccggacctaaaacggccggcatgtgattgtgcaaactcagcggagcattcatgccaggaaaacaggcataaatgtctgggattccccgtccagtacgcctctatccgtcatgatggcgcccggcagggcagccagggcaaaggtggacatttttagcagcgagctttttcccgcgcacaggtcatacactgctttctccacccgctccacctgcggtgcaaggctttcaatgggcagattagacatcagcccgccaaccggcagggccagacttgccagtacccttccgttcaataccacggctatgcccccaccactctcctttaaggtctttgccgcaatccacgcatcctccgggtcccggtatatcatggtcaggttatggcagtcatgggacacggtagtggcaatggcgccttccgtgattccaaaatcccggatagggacaatggttctctggtccagtccataccggttgcacacgcaggccatggccaggccggaatcgtgcctgacggaaatgtatccgtcctcaacaggcagcgactcatagaaggctttattaaaaggcccgtcatatttactgtaaaccaccagcgtcttccccggcaaagcaggcgctttcagcctgaaatccccggggccggacaggcaggacagcttcatggtattggcaaacctgagtccgccgccgcagggacttcccagatatcttccattctcagcaaccagctgcccccggcagaatacatggctgggcctttggccgtccagggcatccaccagctgcatgtccgccacataccccggagcaatggctccaaggtcttcaaacccgtactccctggcagcgttatagctggcgtaacggatggcatccaatggatgggccccatattctatggcctttccaaccacccggttcagatggccttcgctgtaaatcacccctgcatggacatcatccgtgcacagggatacgctgtcatgccagcgatgctccctgattccttccagcgcatccggcagatggttggaaagagaactggtcttaaggttcacatgcatgccctggcggactttctccccgcactcccgggcgctgcggcattcatggtcactttccggtcctgccagcagataggctgcaagggcatttccctccagacggggcgcatggccctgcagatacagattccgcttcaggccctgggcaataatgaggctcatccttgcgtccccctggcatacatccacatagttcatgatttccgcaatccccagcacatccggcatgtccagaagccgggcgatttcctcctcgccaaacacagccccgctgttctccaccccgggtacggagggcacgcaggagggggccagggcaaactggcgcagaggggttttctttgcattgtccagcatgaagctgacgccctggatgcccattacgttggcaatctcatgggggtccatgacaatggtggtggttccccagggaagcacggcccttgcaaaattttccggaatcatcatggtgctttccacatggaggtgggagtcaataaaaccgggaatcagatagcgccctcctccgtcaaaaaactgctccgggggcaatgccggacactccccctctgtccgcacccgaacaatgatgccgtccagtatatccacctgggcaggataaacctccccggaaaacatgttgacaagccgtatattacagacagtcaggtcacagggaatccttcccatggctgccctgaccattttcccacggtccatccatgctgctattttcatatcatttcctcctttcggaaacaggcagtgctccaaacagccggaaacactagataaagaactggatgcaggtcagcagggtaaacaaaatggtaaaaagagacggaagcttatcccttccccgttcatccgtaaacaggtaatacgcgcttttcacgcagcagtaagtcagcaggccgataccaatgccctgggatatcccgtaaaacagagtggaaataatcagcatccctaccgggacccattcctcaatttcaaaatcaatggatttaagcccctgcatcatgacaaatccgataatgagcagcaccggtgtggtggctgcggcaggtatcatcaaaaacaggggggcaaacaacacggccagcaggaaaaacaccccggtaaccacagaggccagtccggtcctccctcccacctcaataccggaggcgctttccacatagcttgtgaccacggtcactcccatacaggttcccaccacagaccctatggcgtccaccagaaaaatctttccgataataggaaaattcccgttttcatccagcatccccatctgttgtcccaggcccagggcagtggccagcgtaccaaaaaaatcacttacaaagaaagccaggacaaaagcaatgtactccggccttaaagcgcccgctacgtctgctttaaaagcaatattcccaagagaggaaagacctcccgatgtaaagatggatgagggtacccggaccactcccatgggaatgccggccacggtggtgacaataatggcaatcagcagggagcttctgattctgtactcccgtcctcctgtcttgacgcggaggaaatacaggataaagcatatgacaatgctgacagccgacagcagcacagaagggtcggagaaatcaccgaatcctctgaagtccgggttcaccagccccgaattaaccagggccgtgcggatgatgaaaatccccaggcccgcactaatgccaatcttaatgtttttcggtatcagctccactatcttttcccgtatcttaaacaggctcagcaccaggaacaggattgctgaaatcatggacatgcccaggcccacctgccaggtagccagccccggcgccacgatggaataggtcagcacgataccggacgcaatccccggcgccagcgcaatgggcatgttggccgccacccccatcagcatggtgataagagctgaaaccaatgccgtggcaatcaggattcccactgtatccatccccgtatcccgcatgttcaccggctgcaggataatgatgtaggccatggtggcaaaggtcgtcatgccggccagaacctcggtcctcacgctggagccccgctccctgattttaaaaaatgtttccaatgtgttcatagcttcctcctttgtatttttatttattagatttaacgttaggacaaactaaactataccgcaatctgcgccggggtccatccgcagaccctcttccgttacagtcatatgatattatggtaatacctttcatagggcatgtttttcctcatttccctattttccatctccctgtcccttcctaatccccgcgctgtcacccctctgcatggcgcagcaggttgaaacggatatggttggtatcatagagagccacgccgtgtataacgggctcgctgttccggtcatatcccactgcctggatcatcagcacggaagctgcattaagaggacatggatgtcccagcatatcttcggcctccttctctgacagggagctgatttccacccagtcccggaccaccatacgcccggtatattcctgaatcacctcaaagttggaccgttcctgccaggctgtccggccgggcacctgggaaaacaggcggaggggaacccgccctatgctgacaatggcgggaacgccgtctgccatataaagcttttccacccgtatgccgcggccttccttcccggcgccaagctgttccccataggcagccggaatcctctcctcttccacggaaaccagcctgcactcaggacggtagccgttgccgctgatgacggagccgaattccagcatactggacagatttaccttcacctgcctggcagcagggttcacaaatgttcccctgccgtgaagacgcaaaagcagtccctcctgttccaaatctgtgagggccttgcgtatggtaatgcggctgacagcaagctgcctggccagttcctcctccggcggcagctttcctgcctcatgaaaggcctggtccgatatcagtttccgcagtgactccttcacggcgtcacttaatgtttttttacggataggggctatcgatgacatatcatgcatcctttccatcttctttcccgttttcatgtttttttcttcgctcatcttagtattatggtaatacctttcactcagtgtatcatatatgtttttccttgcctatggatactttatacgaaatttcgttcccaacttcgatagattacacaaaagcaggcaagggcattttgtttcaaatccccctgcctgctttcattcagaccgttcatcagccatttacatcaattcggcatcctgtttccagccagtaccggcaaagtggagcctccatagggcatcacaatcactcttgcccccggcccgatttcctttacagccgcatcataggcctcctgcacatggtcaaagggctccatgaaaatatcgcggaccaattttggttcaattcccgataccaggaatatcctggcccgctttaacgccctggcaaaggaagcagccttgtgtccgccaatccggaaatccttctgtatgcgttccagtatgctgtccaggtcctctgcctccagcatccactgctcaaacacagctcctcccaatccttccgggcaggcgccggccagaattatgattccccccgggcgcacggcctgctccgcattggccagggctttctgggtctgatacaggttcaggtccttcggcgctccgccctgggagacaatcacaatgtctgccagctcattgatttccgtccggtaaaaaccgtccaggaacctgcatccctgcctgtgagcctcctttaaatcacctgccgctgcgtggattacatttttatgttcatccagcaccacattcagcaggaaatccacgccgcagattccggccgcctcttccaggtcctcccgcaccggattccctgcaagggttcctgcctttgccatgggatgaatcatcctgctgtggtttttacggatggcctccatggtggaaacccccggcatgattgcctttgcaccgccggagtaaccggcaaagaaatggtactcaatattgcccagacatatcctcaaatcagcctgcgccaccttgtccgctatgtccaccggcgtcccggcctttgtctcccccatatggatgaagctgcattcggacgaatccatgcacctgcaggtattgtaaatatcatccccggccagatgccgcatctcctcccgggtctgtctcctgtgggtgcccactgcgaacaccaccgtcacctggctgcggctgaccccggccttttccagccgtttgagcacatggggaagaaccttccaggacggcatggggcgcgtaatgtcgctggtgacaatgaccacatcctttttcccggctgccagtatttcaagccgctttgtgcccaagggcgaatccagggcctgttcaatgatatccgcctcagggcggctttcctcctttttatgggggaccaggatatgggcaatggaatccctgggtatgtccaccttttccgtaccttttccgtagccaagttctatctgctccactgcccggtgccgcagttcatacacatcatttatttttaccacacacgtttcctccgtatccagggaattccttcccccggctatccactggctgtaagccagcataaaggcagccgctcccttctgctcgtctgagacaaccggctcccccagataatacccgatgctcccatcccgctccggccggccggccggtcccagaccagcgcccgcacaggttccgtccaggtggagaataccctctctcaccttcagcttttccgtctccagggccatcatgataaggtccgcccggtccgctgtccccctgtccagtacccccgtctcatatcccttatagatagaataggccaccatggcggaagcggatgtctccaggtaattgcccggtatctctcccagagccgtcagctggaaaaacagccctgtttcccggtcctggtaccggagcattccatccatggcctccttccacaaaccggccagatacttccattcttccgtcccttcaggcaatatggaacagcagtctgccagggccatcagataccatccctctgcccttgaccagaaattaggggaccttcctgtctcagggtctgcccagaactggcattttccttcatcgtatgcatggatgtacaggccggtcccttcatcgtacagaaaccgcctggcattttcaaactgtttcatgacgtcgccgcagttccttctgtctcccagctccatttcatactgaagataaaagggtgctgccatataaaggccgtccagccagatttgacgcggatatatcttcttatgccagaagctgccggattctgtcctgggctgatgccgcagctgttccatcagctgctttgctgccagacggtacttttcctctcctgtctcacggtacagaaagagcagggcgcggccagacagtatcttatccagactgtattcctcactgtcataccactttatcctgccgtcgctgcatatgtaccggtccagaaatatcctgactgcctgggcatagcgttccctgccggtggccttgtacatggcctccagagccgtaaggacgcagccgtcctcatagttccagaacctccggtccagtttcataaactcttccgtgtactgcctgatataacgttcagctgtcatggccctcctctttcatccgcctgataaacaggggctttatgcctcctgcttccagaatggacattgcgtattccccgattttctcacactggaacatttccccggtatccaggtttgtaagttctcctgtcctcatgttgagtttcaggttctggccgctttccacctttcccccgatgcccttgcacaccagcaggggaagtcccagattaatggcattccggtaaaaaatccttgcaaaggattcagccaccactgcccctgcccccatatgaatgagggcaatggctgcatgctccctgctggagccgcatccaaaattagtgcctgccactatcattccgccctttggaaaatgtccggcaatttcttcatccacgccttccaggcaatggctgccgatttcctcgggattggtgagagccaggtaacggcccggataaatctggtccgtgtcaatgtttttccccagcgccagggcctggcctgtaaattcttccttcatatcctcactcccctttccctgtctctgctgtttcctgtccgtccgtttctcccggcatccccgcggacgggtctgtcagatacccggtcaccgcagacatggccacggtggccggtgacgccagataaataccggaatccctgcttcccatccttcccggaaaattccggttggaagtggtgacgcacacctcgccggcagccaggaccccctggtgggcgctgagacaggggccgcaccctggcgcagatatggtggcgccagcgtctatgagggcatccaggtatccgtttgcaatgcatttcttaaatacttcagcggatgccggaatcaccaccagacggacatggggagcaatcctgcgccccttcaggatgcggaccgcctccccaatatcctccacgcgtccgccggtgcaggcacccaaaaaggcctggtcgatacgcaccctgccggcctggtccaccgcgcccacgttgtccacgctggagggcatggaaacctgcgacttcagcccgcttatatcaaagacatatgtctccccatattcaaaatccctgtccgtgtgctccactgtaaacggacggctggtcctgcgggccacatagtcaagcacggcctggttgggctgcatgtaagctgtctttgcccccatctccaccgccatgttgcagagcaccatacgccctgccacatccagctgttccacatagtccccggtgaactcaacggccttatacacagccccgtctgccttcatttttcctatgatgtataaaatcacatctttgggaagcacatggtttccgggcattccttccaggtgaatccgtatgatttccggcaccctgaaccaaagctttccggttatcagtaccgtagccatatccgtggccccaatgccggttcccaggcagccgaatgcgccgtgggtggtggtatgggaatccgttgccaccagaatcatgccgggatataccaggcccgcctccggcataacctggtggcagattcccgcattgatgtcaaaatgatgggtaagcccctgctcctgcctgaacaggcgcatctccctgtgattctgggacgcctcaatggtgggcgagggcgcatagtggtcaaatacaaaggcggccttgtccctgtcccatacggttttccctcccatctcccggaaggaatagacggtctgtagatacaggtcgttaatctccgcaaaatcaatgtcagccgttataatctccccgcttaccacccggtcacggccgctgtgccttgccaatatcttctctattgcatgcatatccttttctcctgtcctgcttatataattctgaatctgtccaacacgcggtaatccggctcaaagccgattcccggccgttccgggggctgcagccttccctccctgtctatctccagggaatggctgaatgcctcatgccacacctggtcgtattccggaggatagtactcaatataagacacattgcccacggccgcccccagggaaacattgatggtctggtccccatggggcgccagctccaggcagtgggcctgggacagggcagctgtctttagaaactccgtgacgccgcccatgagaaagggcgccgggttcaggattgggacagctcctgtgtcaatcagttccctgaacccccatctggtgtactcattctcgccggaggcaaggggaatgactgtcttttccgcaactttcttcatcccgtcataatcatggggcgccacaggttcctccagacagtagatatcatattcctccacctgcctggcaaactggattgccctgtggctggaatatccgcagttggcgtccagcatgagcagggcctgcggccctatggcttcccgcacagcctttaccctggcggcatcctcccggatgctcagggcccccaccttcatcttgacgccggcagcgccctggttcatatacccctccatctcccgctgaaggtcctccaggccctttcccggctcataatatccgccggcaatgtaaacaggcacgctttttctgtattcccccagcagcctgtacaggggcagccccagcgacttggctttgatgtcccaaagcgccatgtccatgccgctgattgttctggtgctgatgcctttacgccctgtcagcttagggacatagagcctgtcccagagccactccgtgcgcatggggtcctgtccgattatcctatcctttagctcccctgccatcataaatggattcatgcccagtaccggcccggaaaggccgtatcccctgattccctggtccgtctccactgtaatgactgccaggccgcagtgggtgtaggtgtgcattccattggagatgggccggcttttctcccacctgaaatattcctgtcttacatctgttatcttcatacactgtcctttttaaaaaggaatgccgcaaaatgcataaccccattctgcggcattatcctcctgtttccttctgcctttactgggcagttgctgtctctacttcccggttgattccgtcaatcagcatatctgcacaggcagcagcgtcctcttccccatagctcagagactggattgccagggtatacacaccgtcaggcgcctttagtgctgcccgctccgtgaatatatccagcttgaaggcagaccatgccatcagtttctcattcatttcagccaccaggctgccctcggtctcaacatatttaaccgcattcttgttgcacgggatgccgcggctgtccccaagtatggtggcgccttcttcgtccccgaacaggaactgtatcagggctgctgcttctgcgggatgctctgaggtggaggtgattgcaatgacctgggacgccttgatggggccgccgtggtattcgcccatgttaatcatgtcgcccaccacgatttctccgtccgtcacagcatccacgtacttggcaatattggtatcccagcacatggcgccgccgtaatggccgtttatccagctctcgcttgtctccagaagctcagaggtgccttctcctgccagcttctcggaattggggataacgtgcttgtcttccagctccttgatgaaatccaggccttccgtgatttcttccttggaatactgaagggtattgtccttaatccagtccctgccgtatttgcactggagataataaatcatcagatgcacttttacataatcagcacaggcaaagggatagtaggaaccgtcctcataggccgcgaatttttcccctgcctcgtacagctcttccagggtggtgggaatctttgccccaaccttgtcataggtggtcttgttccagataaagccgcggcccgtgttggcaatgggcagggcctccagggacccgtttatggtgtagaaggccttgtcggaatcatcgtaattggacaggtcgataatattggaaaccttattcaggtcgtaaaacgtgtctccgttcggggaatatgcaaatacccagtccatgttcagctgaatcacatccgcagcagagcctgcgtttaaggccagggatatcttctcctcatgcccgctgaatgcctcgtactctgcctccaccgaaatattgggatattttgcctcaaacgcctcgatggccttaagggtcttctcatggcgcgaatccccgccccaccagttgaaacgcagggtgatggggtccgccgtattcacttccatgccggcagatgccgctgcctcagtgccggccgcctccgtacccgccccggccgcctctgtgccgccttcggccttggtttcctgtgtctgtgcaggagcagcctcagtctcctttgactgtgtgggcatacatcccgccagggaccctgccatgacgcctgccaaaatcagactaaccagttgttttcctcgttttctcatgtgtaacctcccatttataatataatttttttaattatccctttacaccgcctgctgcaatgccgtccacaaaggaatcctgtgccataaagaacacggccagggacggaacgattgccagcagcgacattgccagaatccggttccagtcaaatccggtttctgtatccatggacatcctcaaaaatatggataccggatatttccgcactgaattaatatagataagcggccccatgaaatcgttggaagcccacatgaactggaacagggcgcaggaaacaatggatggctttaacatgggaacaatcacgtaccacagtctctccaccacgttacacccgtcaatctccgctgcttcctccagctccctgggaatgcctcttaaaaactgtatcagcatgtatacaaagaaggtgtcccctgccagcatggacggaatcacaatgggcagataggaattcagccatcccacttcgttaaacaggatatactggggcacgttcaatactacctggggcagaaacagggtggagagcagaagcacaaacagcagcttcttgccgataaactggaacctggcaaagccataggatgtaatcaccgcagatacaacggtgaacaccaccttcggcagcacgaacttgtatgtatttcccatgaaatgcagcaggttcatgccctcgtagcccttaaacccgtttttgtatccgtccagcgtgggcgccagcggaatgattcccgcactggaaaacagctctgaatttgtcttaaaggacgcaccaatcatccagcacaggggatatatcatcacgattcccaggccaatcaaaaggagataccgcaaaaacaggttaagccgcgctttttcttttctgttcatatgcttacctcccatcctcatccgcatagtaaacccaatacttctggctgatgaatgccaccgccgtaaaggtcatgattaccaggaacaatagccatgcaatggcgctggccagtcccatctcattccgcttaaaagcttcgttatagaccagcagtgaaactaaagttgtggaacgcagcggacctccctgggtcacgatgaaggggccgttgaattcctggaatttatggcacagctgggtcacaaagttataaaatatgaccggcgtgataagcggaaccgtgattttgaagaactgcttccattttcctgccccgtcaatggctgctgcctcgtaaaggtctccctgcactcccttcagggctgccaggaaaatgaccatgggcgaaccgaactgccatacacgcaggagcacgattacaaggaacgccccgtcgggatttcccagccagttaaaggcgggaatccccagtgaccccagcatgatgtttacaaggccctctgtcttaaacaggaacttccacagcacagcaatggacacggagccgcccagtatggagggaatgtagtaaatggtcctgaaaaagttaagtcctcttatcttatcattgagtatataggcaatgaacagggcgaacataagctctaagggcacggttaggaacgcatacttaaaggtctgtatgaatgccttgataatcagcttgtcccccaggatgtatttgtaattttccagccctgtgaaggaggctgtcttgaacagattataggaatggaaactgtaaataaaggaggcagcaaagggatacagcttaaataccagcagtcccaccagccagggcatgacaaagaccagtcctatattgcgtttccagaatcctttcttctttttcttcattcttttcccccatacgtttatttccatccatccggaaggtaatgttctgtattcttaatcatgtcatctgccagtttccgtaccgctccctcgtcccggcatttgtacttcaccagcgggtcgttcataaatgcctttaccaccaggtcccggtcatatgtatctgctgcttccagtatatatccgtgattctctacatggggaagtatcagttcccttaaggactccggaaggggaccggctgccagcgccttgatgctgtcccgggagaacactgcatttgtctccaccacggcctcctttggaaggtttggaatctgcaggaagctgtttggcatattcacattgctcaccatccggtccagtcccaccagggccttaatctgctgtacgccctcctctcctgacggaacaatttccatctgttcctcaccctccatgagacgctttctcctggccaggcgctcctccatctgatggattctgaaatccacggtggtcaggccgaacttccatgacgtaactgtctccgggtcgttgagataggagctgcccggcatgaattccgccagatgccggtcccctgccgcagcaatgaggccgtagcggttaaataagtcaaactttaccctgtggcggcagttaaaggtagattcttcccatgggcggtcagggtcgtcatacccttcctcaaaatgagtccttatatactccctgtagacaggaaacaggtcaactccctcataggatgcagcgtcaaaccaggtaaagtggttgattcccaatacattcacatggatgtccctgcggtcaatggggcccgtccccagttctccggcagcaatggcggccagcactttctgggtgccgaagacctcatggcagcagccaaaggccttgattccggggaaggtcttatagaggctggccacgcacaggctcatggggttggtatagctgatgacccatgccttgggacaaatgtccctgacagccaatgcaatctcctcgtacatgggcagggtacgcagggcgcggaccatgccgccggggcctgccgtgtcccccaccgactgatagatgcccagccgttcgggcaggtgtacgtcggaacgcatctcctcaaaggtacccggaagaatggatatcaccacaaagtcagctccctccagggcctcctttaaggagtaggccaccctgtaatcccactggccactggcctcccttcttcccttcagctgattgccgataatctggttttcctcagctgccctggcatcgatatcatagagccagaccgttccgtccagagccggctccagggccaggtccgccatcagcttccacgcccatgccttggagccgcctcctatgtaagccatcttgatatccgatacatgatgattggtccacttcattccataccctccttgttatgagcacttggagaccgtcctttggtctcctacgtgcgatacatgtcactggcacttagcgaggtcctttcgagcttagtgcagtggcctgttatgagcacttggagaccgtattctggctccctacgtgcgatacatgtcactggcacttagcgatgtctcgttaagttgcattctgaatatcgtatatcgtatacgatttactgtagttttatcatacttccgatggaatttcaacaacatttgtataatattttaatttttggtctattgtcacaaatttttatgtgcatattttcgttccatcccataactaggttttgactcttttggctttgtatgctaaaatagccttattctaagaaaagcgggtgaaacaaatgaaaaagctggattcgctggaaataatgcccacgcgcatccgaatcgcttccattcttcgcaaggcgattctgtcaggcgagtttaaagaaggggaggaattgtcccttacagacatagccaataacctgggtgtcagcaggacaccggtccgtgaagcatttcagattctttcttctgaaaatctgattctgctgagaatgaataaaggtgccattgtaaagggaatcaccaccaaaacaatccgtgagcattttgaaatgaggtctttattagagggtgaggccgctgtcagggccaccctgagacattttgacgtatcggaactgatggaatcccaggtccacattgaaggcctgggagaagatttctcagatgacgagtatcagtcctacaaccagaacctgcacactgccatatggaaagcggctgacaacagtaagatgtattccaccctttcctctctgtggaatggaagttccttcggaaaaaccgtttccgccaaggaccaccagcttctctccatccgggagcacaggaacatcctggaatacatccagtcctgcaacccttatctggtgcgcaaggagatggagcaccacattgagcggagcatgaacaacatcattgacagcttctccttaaaggaaaccaagtaggaaagagggacgcaaaagaaccgggccacagcaaatctggtgctgcaggcccggttctttgttcatgtagaatttaaggaaagtgtatcaattgtctgactatgctgcaaacggagcaatttcctccatcagctggtcacagtcatctgtgtgaagaatcagttctacggttttggactttgccagtgataatacgcctacgatagactttgcgtcaaccatacggcttccgcatttcacatctgcatcacactcaaaacggttcatgattcttacgaaattaataatctggtctgcctggtcaaacttaacaaggatacgtttcatgttgttcacctccgtatggtattttatttagtatcactgccagatacttgggggatggtacttactggtaagtccgtacctgacaatgcctgctaaccttatcttttgtttgtcttccgacatacttatcataccacgttcaggcaatggatttccatggtaatatttttctatctcatggaatattttcaaatattatcctgttatcctttatatctggtccttccagtaaccaatattctccgaatccacctttatcggctctccggctatgacctccagcccgccgtcccggccgtaatccatggaatatgtcacgcctcccagaaccagctcctggtcccccctctcctctatacggcctccggccagctccaggcacacatatcctgccaccctgcccaggtccacgggattccatatgtatagcaccggacagacatcctcagcagcgctgcccacatatgcttccatctggtccggaagccccagaccgatgacctttacctccgacgcccgcccccgttccttcaccacatcggcggctgccttgataccttccgtggacaggcagcacattaccctcaggtccggataggcatccagcatctgctccgctttctcagccgccttttcatattccccttccccgtaggcaatatccaccagccgcaggtcccggtacttcaggttctgaagctcctgcttcatcataaaaatccattcattctggttggcggagcggcttccggcagacaggatgccccactggcctctgtggccgcagatattgtccacctcccggaccagttcctttcccagctcccttgcatccaccgggcttatgtatatgctgcggcttcccgcctccacatccgcatccagggtgataacggagattcccttttccctggcaagattcagaacaggtgtcagtgcatattcatcgttggcagccacagcaatggcctccactttctcgtcaatcaggttctgtatcagacgtatctgttcctgggcagagggatggtccggatacaggacaatgcagttttcgcctgcatcctccactgcctgcttaaagccctcactggccagctcattgtaccagttgttcttggatttcatgataatggcatatttacccctgttaaactggctgctctggcaggaaaacagaaacaacacccctgccatcatggccgctcctgccatccaaacccaatttctccctttcaccgtgctgtccctgccttccttctgttttttcccagtatatacctaatgtcgtattttgtccatttccgttgcaaatttatgatttcttgatacaatagttgtatcggtattgattattgtatacaaatcactgccttttagaaaaggatggatgataatagatgaaactactgattgttgacgatgagaaactgacccgtgaaggaatccgggacagcctgaatccggaatgccttggcatcagccaggtgctgctggaggatgacggcattcacggccttaagactgccctggaggagcatccggacatcgtgctcacggacgtgcggatgcccaggatgaacggggtccagatggcggagcggattttaaaggagctgcccggaacctccatcatttttatgagcgcttattcagataaggaatacctgaaagcagccatcaagctgaaggccctggggtatgtggaaaagccccttgacatggatgagctgaccgcagccgtcaaagaggcagtggacaacagcaggaacgagaaaatgagccaggcagcggccaggcttcaggaaaaggaacagctgggccacctttgcctcctgctgtcccagccgggagaagagaatctggcaaaggcaggccagctggtaactgacctgggccttcccattacccataccacctttttctgctgcatcattattgactgtgtcactcccctgtccgcactgcctgaggagcccatggacggtatcagggattattttgtggattatctcacgtccataggcatatcccaggcctatgtcctcaggggggaccaccgcattattgtcttcctttactccccggagcggcccatggacaagaccctgtacgactgcgcaggtcttctggcccaaaagcttatagaggtctgccccttctttatatccctcggaccggttgtaagcggtatggagcgcgcctatatttcctttcaggaagccagggaacatttgaacgaggcatttttccatgactacggattcatcctgagccacaacatggaaacagccgtattccggccgcccgcagaccttcttctggaattttccatggccctgtctgaaaagcaggaggaggaagccctggacattgtcaggcggctgtatgaatcctttgtgccaaacgacataatcggccccagccaggtaaaggatatctactacaagtatttcagcaagctggacgagcacggcctgggaagctatatctccctgtggcagaaggaagggctggattccgaatccatctgggagggagtcatgaactgcaccattctcagggagcttaatgacctgctggccgcaaaagtacggctgttctttgagcgcctgcggggaaacagcgtgggaaatccggttgtattccagattaaggaatacatccataagaattacgccaacccttccctgtccgtaccggatgtcagcgaatgcgtccgcctctcctccagctacgtgtgcacgatttttaaaaatgagacaggccagaccctgaaccagtacctgacagactaccgcatcaagatgtccaaacagttcttaagcgaccccaggtacaagattgccgacatctcctccaaggttgggtacagcgacggcaattactacagcaaaacctttaagaaaatcgtgggcctgtccccttctgaatacagggagaaaatgcttgcatgaaaaacccattggcaaagctgatttatcattatacctatgacatgcggctgaaaacaaagcttgtcatatcacacattatcctggtactgctgcccaccgccgtattgtcaggctttctttacctgcgcatttacggcattgtcatggatgacagcatccgttctgagcaggccctgtccgcccagaccgtgacctccattgagactctcatatcccatgtgggccacgcctcggacaccatcaccagcgccatgatggtacaggacctgttccatgtccccaggtcagaggccggtaccctggatatctccacctcccggatgaacagcctgttccacctggtccagagcatcacggaccattccatgattacggatgtgaagatatattatgatgacagcgtgtatggcgacctgatgcagtacaacaaaataggcaacgccctgtttaatccggtgtcctcaatcagcagcagctattggtacggcatctacagcaccacggagcaggcccgcatgctgtgcccggagctgtacctgactccggacgagacagagaaaaacggaaaactggcctacatcacccgaattccgtatatccatgacgacggcactgtgtccgacattgaaaacgcctctgcctatgtggccctgtacctgtccaggcccgcctttgacatggtgctgcgcaatgacgccacggtcacggacgaggctgccttccttgtaaatgagcgggatgtcattgtatccgcctcagacatggggctggcaggtaaatactttattccccgctcagacctggtgctgcgggtgggaaaggaaaaaaccttttcccttgtatcctatctggacggctctgcctatgtggcctattttcccattgcagacacggactggtatatgatgtccatcattcccgccctccatatcggtgatgcaggcaaggcgctgatgatgcattttgccctgatttacctgctgttcactgccctggccctgtacacggccttccggctgtcaggctccattgcggaccgcattataggcgtggccctgcagatggagactgtgaggaagggaccgccccagcccatggatatggctgacactggctgcgatgagattggcgtgctttccgatacctacaactatatgacagaggaaatcatctccctgatggacagccagaaaaaggcctcggaggagcttcggatggcggaattccgcgccctccaggcccagattaatccgcattttctatataataccctggatatgattaactggctgtcccagaccggacagagcgagaaggtcacggaggcggtccagaccctgtcccgcttctataagctgaccctgagccgcaaggagctgatgaactccatcgagaaggagctggagcatgtaagcctttacgtccgtctccagaacatgcggtatgacaactgcgtggcctttgtggtggatgtgccggaagagctgtgcgagtacaccatacccaagctcaccttccagcccatcgtggaaaacgcttttcttcacggcatcatgatgaaggaagaaaaaaaaggcagcatcctgctcaccggctggccagagggggatgacattgtattcatcatctctgacgacggggcaggcataccgcctgaaacgcttgatacattaaaggatgacgtgaatgcaggtaccggctccaccgccagccccagacacactgccttctccggccacatcggtgtctataataccaacctgagactgaaaagcctgtatggcgaagcctacggcctttcctttaccagcaccctgggcaggggcacggaggtaacggtgcggattccggccaggcatatcacgtccggctgatgcccggagagtacgcatttttatccaatccatttaactgataccttttacatcccagcaataagattcataggccgccaccagattcatggaggcggtttcttttgccgcctttttctccagataggatgcctggccctccaggtattccgtgttggtcagcagtcctgcctgctgttttctctggagtccttcataggacagctgcgcgctccggaacgcagtgagggccgcctcataggctgtcttcctggcctgtaattcctggtaggaagccaggaacgccgcctcctttgtcccctccgcttcatccaccagcttaaacctgatgttgatttcagtggtgctgctggctgaggtgtgacgggcgttctgcacactcttgtcatttcccatggccctgactttatcgctttcataatccacagcttcaatggcggccatatccggttccggtatggtccctatgaccgcctggctgctggcttcaagtcccagcatggtaagcagctgctgcctcagctccctggcctggagattgagggattccagggaattcctggccgtgtccaggcttttctgtgcttcctttagctgggcctgggtggcggaaccggctgcctgctttctcgccatggcctcccaggctgcctgcagggattccgccctcttttcctgatattccacgttctgcaccatctggttgtaggaattcatcagggtctgggctgtcatggtaaatgtgtccgcagacttctccaggctccgtgtgctcttttcgctggtcatggtatccagctggctgtatatacggctggccgaggattttaacatggctgcattggaggcgtaaactccggctgtctggctgtcctcatcatccatatcctctgccttatcctccatgttgtcctgctcccgcttaagggtatcccatatttcctgataggcgtttacattgtcctcataatcctctatgctctcttttaaggacaggtttccctgtttcagcagttctctcaggttgctgtattctatgtgtatgacatcggctgtattttctgtgttatccagggctgcggcctggactgtatcctgggccgcagcctggactgtatcctgggccgcagcctgcgaactgtcctgggccgcagcctgcgaactgtcctgggccgcatagacagcccgcatgcctgttccccacaggcacagtaccgcggctaaaaggaacatctgcgccctgtttcccttattcctgctgctcttatccatgctgctctcttcattacttcggttcttcatttctgtctcacctctgttccatctgacatgttcctgcgcctaacctgtttctcagctgcctacaaatctccctctctctacgacacggatgccagtccgtccaccgaccaccggtaatccagctgtgccttgagaagggccagcttctgtgtccgcacattgacctgggctgctgcgaaggaggactgctgcgtaacataattgtttcttgtcatggtcccggccgccatcttgcgctctgctgtctccatggctgccgcctcaatctcatacgccttaagagcctgctcgtagtcggatttggatatcatcatgctctcatacgcattctttatactggaagcagccgtctccttctggctctttaaactctgctccaggctggacttgttggtgccgctttttgcattggctattttcttttccagtatcctcaggctgtaattattttccactcccctggatacatcctcctccaggctgatgtctgacattccctccaaatccggctccggcacatctcctatatccacctgggcgccgtaggtccatcccagcatgagacagagattttcttttgtctgtcccagactgctccgggccgacagcagggaggcatccgctgatgtgacgtcttcctgggcggacagtacctgggcctgggttgacataccggcgttcaggcgggtaagcgtctggtcataggatgactgggcctgtatcttattctgttccaggctctccagactgtatgtctggctccagtagcttatcatcagctcctgggcttccttcaccagacctgcctcagtctggtcgtatcccagcttcttgatatccccgtcctccacattgtcatctccctgctcccgcaggttatccgcctgaatctggctgctcaaataggaggacaggcggctggcatagtctgaatccgacgaatccggatattccaggcttccgtatatatcatcggcagcatcatagtaatcatccgcaatatcatccgcatcctctccccggaaatcctcatactccagctggttctgaatcaccgtgttattgtatacatgaatcaggtcagctatctctgtaaattccagctggttatccctgagggaagcccactgctctgcggtataggcaaactccggggtgccggcccatgcctgcaccggcatggcgccaaggcacaatgccgcggccaggcacccggtccctatctttccatatctcatttaattgacacctctttcttagatatccagcaccacacgcttcttatcaccgttcatcaatgcatagtaaatcggcaggatgaacagagccactgccacgcccacgctgagcccgccgatattgacaatggccaggccctgggtggtggaaccgctgtcgcctatggccagggccatgggaatcatggacagtatggtggtaaggctggtcatcatgatgggccttaaacgtgtggctcccgcctcaatcagggctgtttttaaatccatggtcatgcggtactggttcaccgtatccacgtacaggataccgttgtttacaactgttccaaccagaatcaggaatcccagtatggaagtcatgctgatgctgactcccgtaatctgcaaaaggccaaaggagcctataaggctgaagggtatggtagtcattaccataaaggaaaacttgggggactcaaactgagccgacagcaccacgaataccaggaatacagcaacggcaatggcctggtacaaggctgcaaattcctcctgcatcatacggttcatggagtttacgcctttctttatggtgccgcttaagttagggcttatgacctcgctgtctatggctgactggacatttccccctgtataatctgctgtaatggttatctcatatgccttatccgtcttggaaatggaagccgggctgtccttaaaataaatctccgccacatccgtcaggcccacataacccccggaaggcttggagagtatgatatccttcatctggctgacagtccggtactcatcctccggatattccgccatcacgctgacttccctgccatccacatccagggtggtcacttcctcgccgtccatcatctgttttacctgggaaccaatctgggatgccgtaagcccctctgccgccgccagtaccgggtccacctttacagtgaccacaggcgctgtattttctatactggaatggacgttctttacatcgtccctggccgtcatctccgccacaatcttattgctgacttcctgaagttcatcgtaatccgtgccgttgagaatgacttcatatcccctgctcctgctcatgaagctcatggatgaggatgcatccactgtcacggtgcagttatccaggtccgccatctctgtttcccactgctccaccacctcatcggtactcatctccctgttatccctcagataggctgttatggtaccgctgtcattgttgtagcgcagcatgtaggattccacatccggatgtcctttgacaatctcctctgcacgggtcagcatggcgtcggcattttccgacagcaggcccggccttgtttctatggaaacgctgaccgttcccgtatcatccgcagtcataagctcggtttccatcccgctggccagaaaataggctgcaatcacaaggattacagatgcaatcatgatgacggccttgtggtttaaaagtccgggcatgatgcggcggtatccgttctgtatccgctccatgggccgggacatgggcgcctgcatcctctcctgcggtttataggccatataggtaagggggacaatggtaatggccgacaggaaggaggcgcacatacagaatacgataacgtatcccatggagccgaacatctgccccgacattccctgcaggaatatcaggggaaggaaaaccacgcaggtggtggccgtggaaccaaggatagactgcagcacaatgttggtgccggacagggaagccctggcatatcccagcagccccttgtcctcctctgtctctatggccctgaagcagctctccagcacaacaatggagttatccaccatcatgcctacgcccagcaccagaccgctcatggtaatgatgttcagggaaaagccagcgcccgtcatcagaatcagggataccaggatagaggtgggtatggagcttcccactatcagggaggccttataatctccaaagaaaataaatatgataatcatggaaataacagctgccagcaccagggtaagggccacatccttaagggaactgagaatgctgtccgcactgtccctgactatccggatattcagattctcatcctccgcctccaggctctctatgacctcctgcaccccggatgacacatccatagcagtactgctctgctgtttggtaatagaaatagagatggtgtcctcgccgttatagcgggaaatgcctccccggctttcttctgcctcataaaccctggcaatgtcctccagatatacaatctttccgctggaggtggtgatggggacttccttcagggcctctatggtctcatgctccagggaggtggagacagaaagctccagctttccggatacggcatcgccggaaggataggaaagattggccgtactcatggctgtggacacgtcgttcatagtcacctgatactgggccatctcatcggactgaagctcgattttatagtattccgactttccgcccatggcctccacctccgccacagaggaaatctgctccagcaggggcaccacggtctggtccacatagtcgtacaaatcctcctgggagggattggatatggaaagcatcatggtggtgcccgcattgttattcatctccatgacagaggtttccgcatcgtcaggaagctgacggctcagtgcgtccagactctgggataaatcattgtatgcgtcgtccatatcggttccgtaatcatattccagcataatcatggccctgttctcgctggaggtggagctcatgctttttacgccctctatggttcccacctggtcttctatgggctgggtcaccagttcatcaatgtcctcaggacctgcgccggaataagaggctatgataatcagcattggctggtccgtgtccggcatctgctccagcgtggcattgaatacggaagatataccgaataccaaaaggcaaagcagtgccatgaccgtcgccaccggacgttttaatacaaactttgtcaatcccatggtttatgcctcctgttctgcctgtgactgcgtatctttgctgtcttcatccctcaaacggatttttgcaccttcatacaggttggaactccatgtgctcaccaccatgtcgccagctgacaggccggaaagaatctgggcatgctcttcgtcttccagccccacttccacctgggccatggcagcggcgccgtcctggtacagataaacataggcattgcccccgctgtaatagatagcatcaatgggtaccaccattgtatccaatgcgcgttccgttacaaggtttaattttaccgtgctccctgctgcgatttcctgggtgttttcaatctgggcctttaccttaaacagccctgtgtccgcatctaccatggaattgatttcactgatatatgctttgtatgtagtaccgttcttctggatttccagctcatcgcccacattggcattctgcatcatgcgctgggtcacgtagaaggaaactatattctcaccctctccggcaatcacgcacaaatcctgggactggctcaccctgtcatagacctccacgtcaaagctttcaatctttccgttaatgggagaggtgatggaactgtactgcacctgccgttcgtaggccagcttggcggactcatactggagctgcgcggatttcaccgcattgacatactgctcgtattcctgctctgacaaatccccgccgctgtagagaatctgcatccttctcaggttgctctgggcctctgaaagggatacggaagcagaatccatggagttcttagctgtctccacctgctccgtatcaatctcaaacaggacctggccctgtgtcaccacgtcccctgccttcacatacactgccgttacatctcctgctgcttttgcatagatatgaaccacgtcagagggctccactgtgccggtaagccctgtggtaagaatgatatctcctatggacggctgctccgccctcaccactgtgaccgaagcctcctgtcccataggcattccgccctttgatttatttccgcctttcatagcaatcaaggccgcagccagtatgacgatgattccggccgcaatgccaatcttgatttttctgcttttgctcatatccaatctcctttgctggtttactcaactgattcctaatattaaaggttgaagattaattcaacattaacaaatccagcctgtgagccatttatttcgccttattctgtgaattttttgtgactttactgtgtgtctgccttttagttctgattcataaaacttccaataagccaatctcttgattaaaaaatgaatattcttcgatttcctgacaattcgtttatgtttactttataaaaaggtgttatatatgtataatgaagtgtaagagggaggtaacggaacatgtttcagatactggttgcggaagatgacaggaacacccgaaggctgatggaggctgtgctgaaggaacacggataccatcccatcctggcatgcgacggcctggaggccttgaaattattagatacccatcatgtggacctggtaatcctggacatcatgatgcccggcatggacggctatgagctcaccaggcagctgagggcaacggattacaccctgcccatcctcatggtcactgccaagcagctgcctgaggacaagcggaagggcttcatcgtgggaacagatgattatatgacaaagcccgtggatgaggaggaaatgattctgcgcatccgtgcattgcttcgcagggcccagattgtaagcgaacggcgcatcaccatgggagatgtgtgcctggactacgattccctgaccgtaagccgggggaatgagagccagaccctgccccgcaaggaattttatcttctctacaagctcctgtcctatcccggcaagatatttacccgaatccagctcatggatgagatatggggcatggagtcccaatcagacgacaataccatcaatgtacacataaaccggctgcggaagcgttttgaggactatcctgagtttacaattgaaaccatacgcggcctgggctataaggcggtgaaaaacctatgagacacaaaaacggccgcaagccgctgggtaccatgaccctcatcctgactgcagggattttcctaatcatgctcacggtcatgaccctgcagggatttttaatgtatttatactggaggattttctaccaggctgacatccccattccccagttctggcgccccatccccttactggccgtgctcagcgccgtggtgggtgccggactcaccctgctcctgagccgcatccccctcaaacccatccgggacctgattgaagccatcaaccagctggcggacggcaacttcaaggtacgcatccatctggagctgaaccgggaatttgaacggctgtccgaaagctttaaccgcatggcccaggagctggagaatacggagctgctgcgctcagacttcattaatgatttttcccacgaattcaaaacccccatcgtatccctgaggggctttgccaagatactgaaaaatgacagtctcaccaaggaggaacgggacgaatatctggatattattataaacgaatccaaccgcctgtcccagctctccaccaacgtgctgaacctgtccaagatagagaaaatgagcatcctgtccgatatggaaacctttgacctgtcggaagaaatacgccagtccatcctgctgctggaatcaaaatggcagaaaaaggaactggaactgattattgacttggatgaactggaataccatggaaacaaggcgcttctgaaccaggtatggattaacctgattgacaatgccgtcaaattttccccacaaaacggaaaaataaagctgaagctgcaccggataaaggaccagattattttccagattatggataatggatgcggtatggatgaagagacaaaagaccatatatttgaccggttctaccagggtgacagttcccatacaacggaagggaacggtatcggcctgactgtggtggaaaaaatcatccacctccacaagggcagcatccaggtcatcagcgaggctggcatcggcaccaccttcacggcagaccttcccattgaaccctcaccttccagcctgtaagtctgttctggggtattatctctccggatacatttacctggaatcaattccttttgacatatcccgcattttctgatatgataactgtactttacaaagaggagggcgtttgatgtatttatccattcgtttaagataagcagcaagtaaataaaaccttacatggtttttttgttgtgcctgttttacggatgagatgcagatacgcctgatatcatttcgtatattatgtgaattgtccgccgctgaccccggggacagttttctttccgtatgcaggcaaggcagataagaccatattggttttatctgcctttttaggtgtttgaaactgatttaatacagaaaggatactttcatatgaatgactattcaaaatggaaacaaaagttcctgaccattgcagcgggccagactgtttcccttatcggaagctccgctgtccagtttgcgctgatttggtggctggccagcgaaaccggctcccctttaatgatggcattatccggcctggtggcatttctgccccaaatctttcttggtccttttgccggagtgtggattgaccgcctgaagcgtaaatatgtggccattgctgcggacatgttcatcggcctgacagccgtggtctttgccgccctcctgtggctgggccatcccccgtactggtctgcctgcgcggttctgggcatacgggccgtgggaggcgtattccatacgcctgccattcagtccatcgtaccccagctggtgcctccggacaaactggtccgggccaatgggtggaaccagttcatgcagtccggcgcttttatgctgggacctgtcataggagccgccatgtatgccgcgctgcctcttcccgtcatcctgctgactgattttatcggtgcagcagctgccagccttaccatggcagcagtaaccataccggagccggaacacagccatcagggaccccctcatttaatccgtgagatgaaggagggcctgggtatctgcatgagtgaccgaagactgatgaaactgactgcggccgcagccattaccatggtgttctacctgcccctggcctcctattaccccctgatgtccagcacatattttaaggccagcgcatggcatggcagcgcagtggaattcctctatgcctttggcatgatggtatccgccatgatattcggcagcttgggaaaagtaaataataaactgaaagcctcctaccttggactggcaggaagcggcatcacctgttttatctgcggcatcctgccccctgatatgcgggcctggtacgtctttgcagtgacctgcatgttcatgggcggctcaggcagtgtttacaatataccattcatagcctatctgcaggaaaccatacctgccgaagcccaggggcgggccttctcccttttgggaagcatcatgtccctggccatgcctgtgggcctccttatatccagccctgtggcccagattttcggggtaaatatgtggtttttggtggctggaatcggtatcctggcggttgtggctgtatgcggcctttcaggaaatgattagtacagcattgtacagttaaccgtgatatggcacctgctgtcttacacaacgccgtactatggcctgtcagaaaattcatttcctccatctgcacgccctagcggaaagcttatctgcgtccggaagaaatcaccctcctgtccgctgaaaaagcttcctccgtgggcctccatgattttagcgcaggtcttaaggccgattccgctgctctcctttgtctccgcattctctgctgcgtaattgccaatgcagatgacgagacaatccgcccgctgccggtaggacacggttaccgggcggtccctgtccgcatattttaaaagattggaaaagatgtttccgaatacccggcggcacagattgatgtccgcccaaagcctgcagttgatttcatcggaactgcgcctgatgtcaaacccctcgctttccatgtcaaaaaggctctcctccacgatttgtcccaggaactcagccccattgacctcctctgcctccagctcctcccgttctcttccatatacaatgaaatactcaaacaatttatccgaaagctcctttatctggtatgctttatcccggatggaattcagataccttctctgccgtcccctgtcttcctccttttccatctgaagtatgtccacataacccaacaggctggtcaggggggtccgcaggtcatgggacatggctgtgaccagttcacggtttgcctttcctgcttcctcctccttcttctgccgttctttgatggcacagcgcatggcatcaatctcccatgcaagggaggcaagctcatcctttcccttcaccgtaatccggtaatccaggtccccgcccttcagtatctgtatctcctgttccattaaatctatatatctgatttttccgcgaatcagcatgaccagtacaagggcaaagactgccatggatatcacaccgcccagcacgctggcagcagtatagtaaccgtactccatataatagctgattcctgcctgggctgttccgtctgcaaatttcacctcatagagccacgcggtatcctcccattcatccatgtcaggaaccatcaccatcaccttggcatcattactgtactgaaatctgccgtctttataaatggatatgagaagattcttttcccctgaggcccacttatccagcatcttactgtcatgcacggacagcccgttttccgtcacataagcctgaagccgttccacgcctgcctgctccctcaggttcattctctcttcgctgtaaaccacctggtccagaaagctaaaaaacaaggtgttaagggccatatagagagccagggacacaagggcagatgccactgctgccagtgcaagctctgttcccagtctgctgatactccttcttctattcaatccggtacccctttccccatacatttacaatatatttgggattctttgggtctgtctccagctttcttcggagatttctgatatggaccatcaccgtattattggcgctgtaaaagtacgcctccccccacacgctctcatagatattctcaatggtaaacagtttgccccggttggacgcaagcagcaaaaggatacggtattccaggtctgtgagaaaaatctcccctccgtttttcatgacctcgttgaatgttttctgaatgacaaggtcctgtatgactatcgtctccgctccgtccccctcttttcccttgtacacatgataccggcgtatcatggcttttaccctggcagccagctctgcgtaggaaaatggctttgccagatagtcgtcaccccctgccccgaatcccattgtcttatcggaatcctgggtgcgggccgtaaggaacaggatgggagtgtttaactttctgcgtatctctgcacaggctgagaccccattgcggcccggcatcatcacgtccagtatgattaaatcgaatgtgccgtctgccatggatgccgcctgctccccgttctctgcttccacaacctggtacccctcactctccagcaggattctcactacctcccgtatttcggggtcatcatctgcaaataatatcttccgtttgtccaacctgacacctctctccataatcacgcttttaccgtacatcttttcacatgggatgtatcagccatgtaaagctatcttccattatagctcagacataccatctcttccaccagaataaacggatacatttaactattttctttcatcttttttgctgccctttcctaacgccctttcctgtcagtcatgtttgattgcctccagcgctgaaatcttcactgctttgctggccggataatacccggcccccacgcccactgctatggaaaacaggaccgcaaacagggaaagccaccacggtatcacagataatccggagggcgtgtccgccatgtccgtgtccatgactcccatgaccatggatgaggatgacatgcctttggaggtcatattcatgataaatgatatggcgtagctgaacacagtacctgccactccccccaaaagcccgatacagcctgcttccagcaggaatattctccttatgtccctgacaaaacaccccagtgacttcatgacgcctatttccctggtccgttcagatatggacataatcatggtattggtgattcccagggcagcgacgaacagggaaatggcacccaggccgcccagcatcatctgcttctgtctggcctcctgttccatgggcttgcggatggtttccatggaactggtccggaatcccatacgctttatttccgcctccgcctccgccacccggttcatatcctttaccttgaccagggcgcctgaatacccctttttccactccgttttttttccgttaagctttgcctgctggtccagcagggtcttaagcatttccaggtccatcacaaggcccatggatgtctcctcgccttttccgtaatcctccttcatccttcctgcggcttccagccggcgggtgattttcctgtcgtcttccttatcactgctgatatccaatgtataagattctttcatggaatcaaaataaggcgggggcttcacaggcattccgtttttatccagattatcatatccgctgtacatgtccaccgtattcctgcccgggggcctcttggtgtcctcaaatatataagcaaaattctcccccacaaagacactgtctcttcccgccttatcccatgccccgtctgtcagcctgtatcccatggcctgggccgcctttatgtcaatccctactatgctggtgtaggttgacttgtagcggcggttccgtcctgcatacagggtgatggggatgttttccgccgtaagccttggcgtcactacttccactgaccccatttcctttaaacgccggattgcctggttatccagctttgccgaacggctccctttgccggccgcataaacattgatgatggtcaggtctcccatctgggccagcatgctcttctgggcctccttcattccaattccaatggatatcataatgaccacggaacagcagccgatgataactcccaatacagtgagaaatgtcctgctcttgtgacgggtcagattttggatacatatggtaaataaatcctttgttttcatgattcatcatcctcttcttccagctcatcccagccattctgaccgggattttccctttgaacatctaatctcccgactttctttttctttatccacaggactcctgccagcaatacggcggtaagcatacctgccggcagcttccagtccattttccttcctccatccgtttccccgtccattatatccgcacctgccagttcctcggcagcgccttctttcacctggaatgtcacaggaatctccatagtccgtatctccatggactcatcctcatatgtcacctttaccttgccctcaaaggttcctgtctttttcggggttgctataaagtcaatggtcccgctttttccggcatcaaaattccccaggttcaggcttctgtcaatcacctggatatcgccttccagacttgcctccacattgtagacctgtcctctccccttattcacatagggaagtgagatggtggtttcttcattctgacgtatttcctccacaaaagaaggaggactcacatggaaccggtcaggctggtaaacaggtactgcaatggtctcggcggcagtggactgttttctctctgtcttatcaatatactcgtatttgcaggatatggttattttcggggactgtaccttggaatcctttgtctggaataatgcctggacatccacctgctgcgcttttttctccccgggtcccatctttggaacgtaaaatgtgttggatgacgagttgatggataatccctctcctgtttccagggaaatgactacattttcaatgggcgatacctgactggtattcataaactccatgctcagatggaacacctgtcccgctgagactttatcgccatatgtataattggtgagtatgatattgggcgtgggggctcccggtgtggccgccttgccattggtgggcaccacaatacgctctgaataggtgccctggaccgttcccttatctgtatcgtagtcaaattttaatgtgacccccagaagctgggatgccgcagccgacagctctgctcctgctttaaggttcaccggcacatccacggactggcctgcccctatctccccaatctgccgggtatccgttgcttccagaagggatatctggtcattgggctcaaaggtggccgtgagattcctgattcctttgaccgtgtccgtattttccagttttaaaagaatctgaaacggctggccggaattgaccggccccataggtcctctgtctatgcgcagaaccggctggcccgcggcggttcctccttttacaggcagaagcaccttctgggaagaggtggctgatgtcagctgtccgcctgaataatagttatattttaattccaaatcaatgagctggctggggccggaaatatcctgtcctgcaatcaggttgaatttgacctgtccggttctcccggtatccagacggttaatgattcttgcgttggtgtcatctcctatgaacagggaacctcccggtgtcacattgaccaccatatcctcaatatccgcatccctgctggtgttctcaagctccacttccagcgtgaaatggtccccgggccccaccggattctgcggcgagattcttctgactcttatgatgggctgtcccgtggtgcttcccgtatccccattttccctgggagccgactcctcgcattccgaaatgttcacctccagctgttcaggaggaattcccgaactcttaaatcccaccttcagtctcagggcatcccccctgcccgtataggtaagcttggaaaatgtcactgtaaactccaggtcatcctccttatccgatgtaatctttacctttggattttccccattccggaaactgtcactcagttttgttacggttatgccccgtcttcccacctcacttgtcctgaccccattgcttcttacattgaccaccacctttgcctgacgtcctttgcgcagcacatccagggtgtcttttgaaccgcccagggcaaaaatctcatattcactcacccacaggctgccgtttccttcgctgccctgactttctcccccctgcactgcattgccggaatcagagccggaactttccatgtctctgcctggctgtactgttcctgtttcagatgccccagccccggcatcttctgtcccggccccggcaccttctgccccggccccggcaccttctgtcccggcgggaccggtttcaccatccgtccctgcggcggcaatatgttcctgcgccgccggactgcctgcctcctctgccatggcgctgccgcacagtccaattatcataataactgaaatcatcacggctgccgccctttttatccttcccgctatctccatccttaccgtcctttcctttcgtctcccgttatgattccgtccaccagcgtcacgattcggtctgcatacctggacatgcccgggtcatgagttaccagtatgatggtctggttgaaccttctggcaaatcccatgaccatgtccatgatttccgctgttgtttttgtatccagattgccggtaggttcatctgcaaacaccacctcaggcctggacacaaatgcccgggcaatcccggcccgctgctgctgtccgcctgacatctgtgagggatagtggtgaagccggtgtgaaagccctacgcgtttcagcagttcttctgccatggcctcccgcttcttccgttccatccccttaaacatcaggggcatggccacattttcaaccgctgtcatggacggcagcagattataggactgaaagataaagctcatgtgctcctgccggaaggcagccagctcctcctcgctcatccgggaaatactttttccccggataaacacctgtccgtccgtgggcttttccatcccggccagctgattcaaaagcgtactcttgccagaaccggacgtgccgaaaatacagcagacctcgcctttataaatcttcagattaatccgtttgagggctaccacttcctcatcccccatccggtaaaccttccgtacatttttaacatatataatcggttttccatgttccatcatcttgtcactcctcttttcatgggctctatcatagaaaataatcccatggaaattacctcatataaatcttaagaaatcttaatttccctcttgcctgtatttttggatggctctttgctataatggttccatatcaatggacggcagactgccgcctgcagacggaaaaggccgtgccgccggatttaaggtccattgggcacggcctcagaattactgctgccaaaaataagattctcataagtaattattaaatattttcatattttattaataggctgctcaaacttttgacataactgaaccctatacttgaattatagataaacaaaacatcctattaatacaatatatagctttttcatactcagccggcacgactcccatcgcgccggctcctctccttttcagggttcatttcttactctcctgtttcatcctgctgtatcactgctcacccccaaacagccctgttcatcctcttatattccgattcagacggattgccatatacagggctgcaattgcggaaataatatctgccgccggctgcgcatacagaatgccgtttaatccccacagagccggaagaaccaggataatgggaacaaaacagattccctgcctgcaggctccaagaaaaaatccctccccggcctttcccaaggccaggaacagggaagaatacacggtgtagaatccaaacagcagaaaggataatccgttggccctgagagccctctgccctgtgcgtatcatctccatatcatcctttgtaaaccgcgaaacaacaggtccggagaaaacagccatggtcaatccgaatacaccgcagaacagggtggaccacaccacggatgtcctgattgcctcatgaaggcgcttatagtttcccgcaccgtaattataacctgcaatgggctgaaaacctttgataaatccaaacaccatcagacttcccagggaaatcaccctggtgacagcgcccattccggcaatcacagaatccccgtactgctttgcctccatattaatcatagtgatggacaggctggtcagcagctggaaggccagggtaggaatacctattttcagtatctcagacataatctctttggaaaaacagcactttctgaagctgaaacaaaagatacttcttttacggataatgtaatacaggtagaccagggtggagactgcctgtgagatagccgttgcaatggctgctccggccactcccagattcaggacatagataaaaacagggtccagaatcatattcagggcagcccctgtcagcaggacgcacatggttgtcctggcagcgccctcgctggttacaatattattcatggcgacattaaacacattaaatatggatgataccacataaatccctgcatatgtaacggcatagggaaggatactgtccgttgcccccaggcatcttaagattggcttcaaaaaaaccactgcgcagacaataaccgccccgccgaccaacatgctgctgtacagggcagtggctgccaccctgtcagcagtctcccggtccccgctgcctaacagccgtgagatataggatgctgcgccgtttccaaagagcaggcccaatccaaccactgcctgccccagtggaaatgccactgaaatcgctcccatctggctggttccaagtcctcccacaaaatatgcgtccaccaggttatacagcgcattaatcatcattccaaccatggtgggaagtcccatggctaacagcgcccttggtatgggcgcgcttcccagcagctccattttcttattacgtccttccatcttgtactctcctttcacttgacacaagttgtaaaatatagtactataatttatagtagttggccatagggcacatactactataaattatagtatttgtcaagagaaaaaaggaggttgtcatggcaaccatagatttaattgtgctgggtattttaaaaaaagaatccctgagtgcctatgatattcagaaattagtagaataccggaatatctcgaaatgggtaaaaatcagtaccccatccatctataaaaaggtaatccagctggaagaaaaaggatacattaaaagcaatatgataaaagaaggaaaaatgcccgaaaaagcggtctattccctgacagaaaccggtgaacaggcatttgaaagcctgatgctggaacttgcgtccaaacccatcaacatctttctggatttcaatgccgtcattgtgaatctgtcaagcctgcccccggaaaagcaggcatcctgcctggacaggattgaacagaacgtaaacattttaaagacatacctggaagagaacatctcgctgaaggaacatttgccggagattcctgagacaggaaaggcagtactgcagcagcagttcatcctggcccaggcaattgaatcatggattgcctccctgagaagtactttgccggaattcatatcccttcccgatcaaacatctccttcagcctgagggcgtcctccagcgtattcctccagccatcccgtttcatgtccacacgtccttttgccgataccaggacctcttcctcctccagaagcattctctgcaggtccgggtgttcaaaggacgctgcgccggtcagatatccctgtccgttgaccacacggtgggccggaacttctccagccagtccgcggttcagcgcgtatcccacctgccttgcatttttcggttttccgcagagcagggcgatttgaccataggtggccacctttccttccggcaccgccctcaccgcaatcccaacccttttataaaaatccatcttttccatcctcctgcaacagatattctgtaagcccgccatcagactcctcattataaaaacatatcaacattgtaccatggcgggtgctgatttaacagacccggcaaacaacaaagaaggcccgcaggacaaatcccgttactgttcagaggtatcataaatcagtatcggcaaagtgacgaaatttaaaatttaagaaatagcgtattttgtggctatgtctaggttctaacccatggcttagcaccatttttttagttcaactccgaaagacaggtagtataaacgtttacatattttccatcaagcattttttgcaaaaaagtttaacagatttttaacgccatttttatgcaatcttcacaatttaagaattttcaaaaaagtttatggttttttccgctttcattttgacattgtttcaagaaacctttacaatatctgtgtatgcatttatagagaatcacagggaggtggaccggaatatggtaacaatcaaggacgtggcaaaaaaaagcggctattccgtctgcacggtatcccgcgccctttccggcaaaggatatttaaaagaagagaccaaacagaaaatactggagacagttgcagaactgggataccgccccaataccctggctgtcaacttaaaaacaggacgccgccagaccctggccctggtcctcccgtccctgaccaatatctactacacaaaactggaacagtacctggagtcctgcgcagcagaaaagggctatatcatttacctgaacaatacggaatacagtctggaaaaagaaaaacagattctggaaaatctaatcgggatggacattgccggcgtcatcattactcctgtcaccagccagcatgaccacatcatgaaactggctgaatacaacatcccttatgtatatttaaaccgttcctttgaggacgacctggaacactgtctccgcctggacaataaaaaagccgcctatgaggcggtctcctatatgattaagctggggcataaaagcatcggcggtatcttccagagctttgacaaccgtacctaccaggaccggtatgacggcatggcccttgcccttaaggaacacggcctggactgcagcccgggccgcatgctctttgacatcaatccggaagacatgggcaccacccccggccgaatcctgcagctgctccaaaagccggaccgccccggggcgatttttgcctgcaacgacatgaccgccttcaatatctaccgggcctgttatatccttgggctgcggattcccgaccacctgtctgtatttggctatgacgactgtatcatggccaactttgtaacgccgcccctgtcaacggtcagcgtcccggtccgcaggctggccggaattgccattgattttatccatggttatctgcaatccggtgtcctggcagagcttccggtgctgaaagcctccctggtcatccggaattccgtgcggaacctgaacctggattaaaccatatttgaaacaccctttagagtgcatccatatcctttcccggatacaccatcaccagctgtacactgccctttggcaggatttggtacgcctctgtcccggcagctatcaggaagctgtcccctgccttcaggctgagcacctggccgtcctgttccatggtgcagcttccgccgcataccacccccagggtaaatttatggttatgccccacaacagcaggcccggtcacctccagcttctccacaaagaagcaggaggtcagcttttcatccaccagccccacccgccgataggcatctgtttcctccaatatccgaggctctatcctgcactttttcatgatttcttctttggaatactctgtataatcaaaaatatccagacaaaagtccagcccccgtcccatgaacctgccttcctccggcacaacgattccctcacgctcaaactcgcaccggaccaccaaatcagacggctccatgatttccagcatggtgattccctcgcctatggcatggggcattccgcccggaatataccagacctcccccacctgcaccggaatcttctcaaaacagccgtccatccgggccttatcctgctgctccacgatttccctccaggcatcccttcccggtgtgtgctggaatcccaggcggatataggggctgacgccgtcccttacgtggagaatgtaatagcattcaagcttcccatagggcattcccatcacttcattggcaaaccgtgtggtgggatgggcctgtacgtgaagccgcatggctgagtccagaatcttgagaaggaagctgagacgccagctcccgtccctgccaacgcccgaacccagatagaattcccggttctcatctatcaggtcccgcaggaacctgggcccatcttccgtctgcaccgcagccagcccctcatgtgcaatgggctccattcccggattggaggcttccaccatggaacccacccattcctcgggcatattgttatccgcccactggtccttaccatggaggcggtcaattcccgctccccctgtataatttcttcgcacccggttttcgggcagtttcataagtcctgctgtcattgcgccttcctcctgtcatgatatatgtgtcttgatttgcctgcattactgcatctgccggattttttgtcttaccgcatctgtctcactgcatctgccggattttttcaatcaggtccagatattctccgccgtatttccggtataccggctccatggcccggctccaggcgtccgggtcctggggttccagaatcgtaacgccctccttctccagagcctcatatgccttccggtccgcttcctctatggctgtccggttatattcctgggtttcttctgccgcctgtaccagagcgtcctgatattccttcttcaggtttttccaggtgattttgcttaccagtatcacccccggcgtataggtatggctgtcctttacataataaggggcaactttataaaatttattataataatagcttaccggcgggttctcggctccgtcaatggtccctgactccagggccgtatagagctctgcataggctatgggcactgccacggcccccagtgcttccacggtatcgcccatcatggacgccacctgcacccggattttcagtcccttcatatcctccagcctacgcaccggccgttctgtggtaaagaagtttctggccccttcgtccatgtaggccagcccaatcataccggtacagtcctggatattattaagtatttcccttcccaaatcactgctgcatacattccagaaatgctccctgtcccggaaaacatagggcagcaccagggcagacatcatgggatttccgcaatccaccagggacatgctgttgccgcggtacaaatccaatgcccccatttccatggactggtaacagcgggcatcgtcccccagctggccggaaggatagatttcaaccatcaccttgccgccggtcagttcattgaccctgtcagcaaaaaactgggccgactctgtcagcacatggccttccgggttcacctctccgtaacagagcactatctccggttcattgtccgctcccgctgcccccctgtttcttaaaactccataaccacctgccagacctgcaatcagcactgcggccgcggcacctattattaactgtcttttcaacctattcctcctgacccggacccatggcttcctcagtgtcattccttctgaatcctcatctcagaaaagtactccacatgatattttaaattatccccgttaaaattaagctgtcccagcttttcaaaacgcatggctgcctctgaggtcttaacccttattcccggcatccggttgattccccggatgatagtcatcaggctgcggccgaaattcagcttcaccgacacatcctgatatcctaaaagagtttccagctcctctatcatctccgtaaaaaggacactgctctggtcctggtcctccccggacagggactggataatccggtcctccagaccgcagattcgtttcatgccttccgtcatattgtcaaaggcaagcccggcctcctccgcagaatattccctgataaaagatgcagcctcctcatatgccccggccagttgttccattccctcataggctccgctgacaccgcaggcaaccggaatcttccgctcctctgccaggtaatccctggccctggtaatgcagccggtcagctccgtgaatgcatcctgctgcggtgaataaaggcagataatcatctggtccatccagatactgttaagtacagtcacccctgccatgtggaaatagtttttaagcacctcctgtgaaaaccctcccatgctgaccagggccggactggaaatcagcaccaccttaaaccacccgggtcccactccccacatggcaaattccttttccagcttttccctgtccctgcgtccaaaaaacaaattccacagcaagtccttctccaaatccctgtaaaaatcaaaggcagcctttccatcatccaccagataattggaataggacagcatggacagggtatcctcccgttccctaacccgggcaatgaccttatccagtgtctcccgcagctccgaatccaggtagggcttaaggagataatccgtcacccccagtttgattgcctgtttggcaaaggagaaatcactgtaagcggaaatcagcacaatctggatatccggatgccttttgcgcacctcctccgctgtcttaagtccgttcattctgggcatcttgatgtccaaaagcacaatctggggcttgcactcctccagtttttccattaaatccataccgtctactgccttgtagacaatctccagcagaccgggatagctctcctttatgaccttctccagataattccgctcgtactgctcgtcatctgccaatattacacgcaacataactgtatcctcctaatgcctgtctgatttataaagcttcagcgtaatcctcgtaacgccctctgtccgcccaatgtgcagcacatcatctttccgataaaacaattttaaccgttccctcacatttttcaggccaatggaggttttgggaatgggcgtttcccggcaggcgggacgattgctttcccgggtccggcctccggcttccggctggtccaggttcataagcagtcctccggtttccggctgttcccggtcctccggaaatcccacgccgttgtccgccaccaccacctcaatataatccggcttctcagtaatcagtatatccaccctgcccccgctgaccctgtccttcagcccgtgctggatactgttctccaccagaggctggattgtcagcggcggaatcattacatcctcgcccataaatgacttgcgcacatccagacagaaggtcactctcccctttaaatgcagcttctgtatatacaggtatgactgaagcagttcaatctcagcatccagcggaatggaaaccgtattgatttcaatgctgctgcgcaggattttggaaatggctttgaccagctggatggatgtgtccctctctcccagctggatactccggattaccagactcagtgtattaaacaggaaatggggattcatctgcatctgcagctcccggatttttgcctcggccagccgttccttcatctggtgcgtctcctgtaattccgtaatcatggtcctgatttgccgtttcatctggtcaaatgtggcggaaacctggttcagctccataaaaggcgtttcctcaatatccgctgcctccaggttgttgttcatgatttcccttgcagcatccgtcagccgtttgatggaattcaggatactggtgctcatctgatggttcagcaccattccaaagaggctggctgtcatgaaaaacacaatcagaatactgttagtgattctcagcgtcctgctgtggctggcaaatgcagtatttaaatactccaggtactggctcatcaactggttgagacaccgctcaatctccaaatccacttcgtccaaatcagccatcagactgggatagtaatccccgtcaggccggatgtaggactccgccatctcccgcctgtactcagccacctgtcccacaatccggtacatcatcttacatttccggtcattctgcatcttttcatccaggccccgcagctggctgtcaaacagctggcattcgtcataatactgcttcagcgtcccctcgtcatggcttttgctgtacagcttaaaataggtctgcctccggttattgacagccagcagcccgttcacctgctggtaatcctgtaaaagcccgttgtaccggcgggatgaccccacgttcaccagggcattggatgctatgaagataaaggccaccagcagcagaatcaggtggtttcttgtcatttcttttcgtatggatttcataaatctcttctcacttttctgcggggatgtttacttgggggatttttcttctgaggttattctacaacggcaggggaagaaaaacaagtcagactgagtctgacttgttggctgaaagtaacgttggctaacttgttggcgggtaagatatcctgcttcatactattttatcttagcaagctccttatactcatgtactgccgccacatcaatgtataccgccggccgttctgtcactttaacattgccctgtccatcctggctttccactgtctggggctccttcagcctggtaatgccgagaatacgtaccgaaccgtcccgccacggaatggtttcctttaatcctttataatcctcgggacaggcagggtgacgggctcggattcctctctgttcaaaaacgtgattcctgaatatgcatctgaaacggcccatcctgctgctcctggggaacgtcgaacaggcatctccctggggggccgggtccgcctccgataatacgattcatgcacgggtagcccttcaaactattctatattgattgtcttgatgccgggtatgtatatctgaatggtataacgttaaaaaactacagcaacccaaccggaaggacggacaggttatggtaaaaccacctgtccgtcctcccggttgggctttctatcatattattgctttcccatacattcgccgtgatatccgaatcaaatcagtctcagcttttgtgctgccttttcttccacagcttccatgcatggcccaaacagcttaattctgtcgtattcctccggattatccagaatctgtcttctcagttcccgcccaaaggccagacgcagcgttgtacccagattaatttttcccgcgccgcagcggaccagctttcccaaatcctggtccggcactcctgttgccccatgaatcaccaggggcacctttacaagggtatggattgcctttaaacgttgaaattgcagtgcagcttcctgagccaccatacggtgtacggtgcctacagcaaccgcaagcgcatccaccggagcggccctgtaaaaagcttctgcttcttccggctcagtatatcgcggtttaaagacaagggacgggtcactgtatcccactgccccaatctcagcctcaacgcttaccccggcagggcctgccatatccaggaccttgcaggtcagctctgcatttttctcaaatgtcagttgggaaccgtcaaacataacagacgtaaatccatgggcaatcgcctcctgtatggttccaagctctgttgcatggtccagatgaacacatacaggcacttctgcttcctgtgccacatggcgcagtatacatgccagaaccggaatccccatatgtgccacagcgtccttattggccatcagggccactggccgtccctgcttttcagctgcatggactacagcagcagcatcctcatacccgaacacgttaaaagcggccagccctcttcctccgcgctctgccatctgcagagcatatgcaagtgtacttagcatcctctgtccccgctttcccttctggaaacaatctctccataccgctgtttttctttatgtataaaggcttccagctgctccctgtcaggcatgaaactgctgcagccgtgactggccacaagcatggccgctgatgcgctgccccgttccaggcattcattgaccggaaaaccttccagtaatgcgcataaaaagctgctggcataaccatctccgccgccaaagcctttcaccgccttgactggaaacggctgcacgtgatagctttccccttctccggtgtaggcgtcagatccctgcctgccatgtttgattaccacaattttggcattctcccccagccaccggtctgctgtctgcctgtcctccatgccgggagccaggaccgcatccataatatcatattcctcccggcttcccataatgatatccgacattctgcccatcagcgtataatagacagatatctcctccgcatccttccaggtgtatcccctgtaatcaatgtcaaaaaccaccacagtccccgccttgcgggccagcagcgcagccttgagggcggcttccctggaaggactggctgccagtgcggttccgctgattacaatcatccccgcgctctgcacatactccttatccacctgttgggcggtaagggccaaatccgccgcatgattccggtacataaccaggctggactcttccggggaaggtacctgcgtaaatgccaggggcatggactcaccgtgctgtgccgtaaaaatatgggagacatccaccttttcctgttccagaaagtccttgcagcaggttcccattacatcattggacacgcatcccaggaaaccaacttttttccccagccgggcagcacccaccgctatgtttgcaggcgagccacccacatatcttttaaatgaactgcattcagaccagggtttacaatactcctccggattaaaatcaatggcaatgcggccaagggcaatcatgtcaagaggcctgtccctgtcaaatgaaacaatactcataatacacacaccttttcttctgtcccatttttatgggaacaaatcaataagttcttctccctttaccgatacctgggccagaccataggtactgagtttgtaggaaggaaactgggtaggataaaccatgaatgccatcttatggaaaacactgtccaccacgcatccgattgcctccgccgcagcattgactgctttcattcccgcaatcacctcctggtacggagcaggcgatacaatgcctgcaatggagagttccagggatgccagtaccttgcctcctgacactaccacaaaacctccattgtgttcaatcagatagttggcggcaatgcgcatgtcctcatcattgcttccgataatattcaggttctctatgcagggggcgtaggattctgcaattgctccgttgcgtataccaaagcctttcacaaagccgattcccttcctgcccgattgctggtgccggtccattgtaaaaatcttagctatatcgcgttcagggtcagcttcaataaagccgtcacgcgactccatctcctccaccagggggtctgtaatcagaggatccccattcattccgataacgcgcacccttacacatccctcataaggcgcccttacacggaaatcgtccggggtaaggggcttcaggttcatggaatgcatgaattcatccggatacctgggggctgagatttctctgcaatagcttccattcataaccagcatttcaccatccacaatcacgctctccacatgtacctgttccaaattgtccagaagcaggatatcggcgcacttgcccggagcaatacttcctatatcgtcctccagccggaaaaaccgggcgacattcagtgaaccggcacgtatggccagagccggtgaaacgccgcacgcaatggcgctgcgtacctttgcatccatatatccgatatcattcacacggctggggtctatctcatcggatgcatacccaaaatctcctataagttcgaacttcccccccaaatccggcagcacctttcccagttcctgtccaacagagccttccctcagatgttccgcaattcccaggcgggctttttcgttggcttcatccgccgccacagtctcatggtcgctcacatgattggcaaagctcaggcccgcctggagcagtgttccacgcacgccggaagcatggcctaccaacacctttttaagtttctgcgcttcatgcacgattcgcagaagactctcattcttccctgccacacgggccaggttaagctcattcacaccataacaatcatcccagtgaagggcctctatggccatctcctccgtgaatgtgccaaggttttcaaaagattcattctgatgaaatgcaggcagcggaatcacaaacattggcttcacccctgtattcttaagctcatccaggaaaaaacggattcccttcagggactttataattccgatttcaaaaaatcctgtagccactgccgttccgccatgcatcaatgcaacctttccaaattccgtcatgctcatatgcgtaccggcaatatggagatgtccgtcaataagaccaggagcaaggtatctgccggaggcatcaatcttctttgtctccggacctatggtgtgggatacatcccccacataggcaatccttccatgccggacggccacgtccgccggatatatctccagagtatacacgtttaccagtgttcctcccagtattacggtgtcagccttttcctcgccccaggcagtattcagaatacttagtttttgttcaaatgtacaatccttcataccacacctccaatggccgcctgttccttcacaggtttgcccataattgaattaataatgttgcgttcattgatggcctcaccctccagatgtgcgcagatttcaccctcccggatacagagcagacggttggatacacctatgatttcaggcatctcagaggaaatcagtatgactgccattccctgttctgccagctgcgcaataaaccggtggatatctgccttggcacctatatcaataccgcgtgtaggttcatccagaatcaataaatcaggttggattgccagccactttccgagaactatcttttgctggttaccgcccgaaagctgtactgtgagctgctccggactggctgcattaatcttaagggcctttttatattcatcataaatgcggtagctctgggaaaaatccacaaatccccttcgcttcatccatggcagctttgccagaatcatgttcttccggcagctctcccccagtaccagtccctgttcctttctgttttccggcacaaatgccatcctgtggcgtactgcgtcccggctgttgcgcacccggattttcctgcctttataataaatctcaccgctgtcaggcctggttatgccgaagatactctccatcaactcagtccgcccggccccaaccagaccgtaaaaacctacgatttcccctctgcgcacagaaaaactgatgtcctggtactgtccttttcgggtcagatgttctacccggagcagctcctcccctgcttcagccgtattcttcacataataattgctcattacacggccaatcattccctggataatatcatcaatggtacagtccgccgtgttgaattcccctgaatttttcccgtccctcagcacaacggcgcggtcacaaatttccatgatttcatccattttatgtgatatatagacaatggccgttccttttttcttcatataccggatgttctcaaaaaacacattcttttccctgtcagtcagggaggatgtgggttcatctaaaatcagaatacgcgcaccaagggcaatcccccgtgcaatctccaccatctgcctctgagcgattggcagcgcccctatattcgtcctcgggtcaatctcacattttaattccgccagcacgcaggctgcatcggaccggagttttttccagtccacccctcccttggttctcatgggcagactccccagataaatattctctgccacggataaatctgttaccagagacaattcctgaaataccataaccacacctgcctgctttgcctcaatcggatgtttaaagcagacgcttttgccatcgtaatggatttccccctcatccggctgatacaaaccggccagaaccttcatcaacgtggatttccccgcaccgttttccccgcacagagccagcacctccccaggcttcaggtttaaatccacatggtcaagggccttgacacccggaaaacttttgcatatattcttcatttgaagtatatacccattctcggcttccatcccgtcacctccttgttatgagcacttggcgcctgtcctttaggcgcctacgtgcgatacatgtcactggcacttagcgaggtcttttcgagcttagtgcagtggctcgttatgagcacttagcgtctgtctgccagacgctgagtgcgatacatattttgtttaattccagatttcaaatcccgcatccgcaatgacttgtttcacattctcagaagtacagggatataaatcatagcgggtaactgcgtctacagcctcacccttagccagcttgatggctgtatccagaactgtgactgcgtccgggaacggtgactgcagtacgcttccgctgatgattccctcctcaatatatttaacactttcctcatttccaataaaggcgcaggcaatgatggggatatccatattggctgcctgcagagcattataggctcctattgcaatattgtcatccgctgcatacagcgcgtcaatctggtcaccatattttaaaatcattttctccatctgctgctgggccttctcccggttccaatccgcattctgcgtctccagaatcttgatattcgcgggaatactttcctcaaatccgttctgcctccaggtagatacatcgtatccaggagtaccggtgagctggactacattacagccgtccgggaacattcctgccagcatgtcggcacacatgacagcctcctcgtaatggtcaggtccaacaaatgcactcagatattcatctccgctggcatcaatgggattgttggtgcacatgatgggaatccctgcttccttagcttcctgcagccccggaataatggaaagggaatcgcaggcccacacgataattacatctgacttctgctgaatcaggtcctgaatttggctaatctgtgtgttcacatctcctgcagcatccagcacggtcaattccacattccccacctctgcggcatattccctcagacattcatcacattttgtctggtaatcatcgattccaatgttgtttgccaccattccaatgcgatatacgtccccctctgcagcggcggctgtctgtactgattccccggtctgtgcggcctgggctgctgtcgtatctgcggcggcagaagtctgtgaagctgtctgtgcggttcctccgcctgcacatgcagtcattcctaaaagtgttgctgttgcagtaaacaatgcaaaaaatttttttgttcctttcatcattgtaaccccttcctttatttattattttttctctttttcagtagcatgtttatcatcagaattatgtttatccggtatattgtatgcgggcttttcccgcagtaccttatccatatacagaaccagaataagaatgataccgaatactaatgtgttatagtaagaagacagctttagcagattcatgatgttgtcgataaagcccagcaccagcaccccgccgaatgtatacagcatgttcccgtaaccgcctgaaagtttagttcctcccagcacaacagctgcaatggccagcatatgggcatccggccagcccagtgtgggagatgcggagttgaacttagaggcatacattatgcctgccacgaccgcgcaaagggaacagactgcgaaattgatgataacggtccggtccacattgatgcctgcattctttgcagaattcatgtttccgcctgcggcatatgtattgcgtccatgacgcgaataccgcaaaaccgcctggcccgccgccacaaatatcagacacagccacaccggatatgacaaccccaggaaactgttccggctgagttcgtaaaagccttttgaagtattccgaatcgtctgctccgtataaatgaacgtaaggccccgccacagtgtcattcccgccattgtcacaataaaagcattaattttcagcttagtaaccatcagcccgttaagagtccccacagccagaccaaggagaagcatcagcacaatggctgcaaacaaccccacagacggtgtaatccccaccaaaaggcaggatgcaagccccatcagtgtcccggcggacaggtcaaaatatccattgagtatcaggaatgtcatgcccacagccataacgccctttgccgcattctggcctaagatattgataaaattttccagggagaagaagtttcccacaaaaagcgaagctgacaggaacacccccagaaaaatggggattatcgtgttgctgcgcattacagccgtaatccttcccgcaattctcttcatgcgttcttccctcccttcatgttggtccgaatacgtttggatcggatgtcaatatagaccactataagaataatcagtccgttcgccacccactgcatggaatatggaaggctcatcatcacaaaaccattatccagaactcctaatatcagaattccaatcactgcctttacagcgctgccgctccctcctgacaggctggcgcctcccaggataacacccgcaatgacgttcatctcgtaaccttccccaatggcattctgcgcggaaccgatgcgggatgccaaaaggataccggccaaagctgtcatcattccggaaagtataaatgtaatgagcacgattttcttatcatcgacaccggagaaccggctggccacctgattgccgcccacgctcataagctgattcccgaaaacagtgcactttaacagtatttcaaataaaatcatacagacaaaacagataactaccactgtgggtataaagcctatgaatccccgtcccagggacaaaaaccacattccgtccgcatttttaagggtactgttttttcctcctgagacaaaataggtcagcgcctggacaattcccatcattcccagtgtcactatcattgagttcaggcgcacatatcccaccagaaacccggaaatcagcccaaaggcaatgccggccagcaagaccagcgccattgccggcacaggccccacagtgttaaacagctgtatcataagaaccgtggaaaaggacagaatggaacccaccgacaaatcaaaattacctccgatgattacaagcgtcatggcgcaggccatgatgcccatgattgcgccctggcgcagaatcaggataaagttattaacctggaaaaacattggggcggcaattgaaaatacggctacaaccgcaataagggcaaaataaattccctgcttttttataaaggctgcggcattctttcctctgaattgtttattgtccataatcaacccccttttcatcaggacaagctcttaatccacagcagccttcaaattctttaaatcctcctttaccagggacagctggtccagttcacagcaggccctcaaaggaagctggtcgtaatagttttcaagaatcatccatccttcatatcctttccccaaaagaaaatccagctggtcctttacatgggcatcaccggcaaacaaaggcgaaccgctgagatgtcctccattgtcatacatcccggttccgtcctttacatgaatctgaggatagatatgtccccataacgcccgaagtgtttccatctggtcgattttcccccaatagcggtaattctgtacgtcataaaatacggtgtgattgggcatgtctaccatctgcaatagcttcagatggctggccgcatcaatgcaggattcgctggtaatgtcaatcccgtaggcctgggccttcctacagcaaaaacgaagtccctccgctgcattttcataatcctcctctgtctttggctcgttatccagaaacagaggcaccataatcattccaatccccatggcatgggctgtttccaccgccagttccatctgttcataggaaatctttccaatatcgctgtttctgccctttatgaaataattcacattaatgtcgttcagcaccagggacggaaactgaattccatacttcccgccttcctccagatatgcctgctgaatctgtttctgcgccaggggatatcctctctcatagctgccaagctccagctgaagtccatctaatccagcctcttttgcaagccgtacgccataccagccgttgcccggcattccccactgtgtggctccgtatttaaattttcccattgttatcttcctttctcttcactccatcaatctcttccagcagagtacggatataggccagccccttctccgcggcctccagttccgttggtttcggcaggcattccatactaatccatccattgtatctgatttgactcaggctcttaaggacggaccggaaatcaatccggccatgtccgggataccagcgagtgttgtctgccagatgaaaatgccccagcctgctcccgctctccctaatggcctcaaacatatctgcttcctcaatattcatatggaatgtatccagatgcatcttcacacagtccaaatccagtgcctctaaaaatacggatgtttctcggaccgtgttgaaataattattttcataacggtttatcacttccagaaccagagaacagttcttctgttcaatgtaatttcccaattccagcatggaataacgcaggcgggttacaacctcgcttttctccccgccagacggcacattcccccgcagactgcccagaatcacacagcagccaaagtggtccgccaggtcgagacatcccttaaccctctcaatagcctgacggcgtccagtctcatttttatcagcaagggaaagaccgtccaccctggcggctaaacctgttccgattgcagccaccttgattcctgtggtttcattttgtctgaaaagcgcctgggtatctatttccgaggcgtccctgatatgcagctccaccccatcgtaccctaatttctttgcaagggaaaaggattggtccagtctgccgcggaaaagcaccggttcctgcatggctgcattttccgaagcacaaaatgcgacttgtaacatagtcttcctcccatcagtctgtaaaaataccgcgcctcggtaattcgtgtacactcttccagccttcactcaggggttccttcaggcagtccttaatttcctcatagggacggagtgaaaacttctccggtgcaggtactgtgcctgcgggatatttggacaggatatcctctaccatcatggtaagatattcacagatagctgcaatagggcgcttagccttacgcggattaccacgggatggaacccctaccacgccttccggtgtaccgaaccgttcaatcacacggtggccttctgcctcgctccacttatttggccggtgaaaactgtcaacagaaccgtcatagtagccgtcgtccaaaaatcccatgctctttgcctgtgcatcctgcacataactcatatccaccatatccttgaacattagaagggcgactgatgtctccgactcatccgcatgcacaaatggcgttgtcacaaaatcaggacgtttgtccccaattggataaaagaattcccgcactgcacggtgccattccactaccgtcacaaaggccggcagctgatagcgtttgaagaattcctggacagctgcttccagcatccagtccattccatggttgttgacaaatataattttgcggaagccgtcatcccaaagccccagcatcacgtcaatcagtgtttcttccaccacggtctgactggccacaatggttccgggcattcccagatggtgatacggatgtccgccatagttaagaggcggcagggccagggccacttcatgtcccagcttggccgtataacgccgcacgccttcgcatatgccgctgcacatgaatgtgtccaggccggaattattgtgcattccatggttttccgtacaccctaagggtaccagcacaatatcatttttgcggcgcttttcaattacctttgcccttggtgtggtctgtatataacaccctgccttgccaatttccggttcgctgggaatctcatatttctgaaggatttcgtcaatctcctcctcactcgcatcccaaatacgctttttcattcttcctacagccgaatcctcaaaaaaaatgttaggatactctgttgtcaggtacttatcatacattattgcagtctcccttcctcattgtatgttctgctctttgcaggttctgtatttgtatctcaactatagcaccggggtactgtaatccacaatgtacgatggtcaaaagcgcctgccttgtttttggaaaattgcccaatttttcaaaaaaatcccccctcctttttataatccattactcaattcttggttgcaagaccaatttttttctcctataatatagatattgttccacacggcacacatgatacaatgtaagtaaaaaggagtccccatttatggatgtcacactgaatatgatactggattatattgcaaaagaagaggtaatcaccctggaccacatccatacccatgtgggattctctgatatccgggtgtattatcccggtatacatgccaatccctcctatctgtactaccatgagtctcctgccttccagccgccggacgcattcgaggcctgctgctttgtccatcccatcagggaaacccaggaagcctcggctcatcatcacaaatgtattctgtgtctgtgcgagggcggaaaattactggaattgctgcaggattgttttctgacctaccgcagctggtatgtggatatgaaccggaaaatcttagaaggaggaagcctccaggaactgattgacatcagccagaaaatcattaccaatcccattgttatagacgacgctggattccggattctggcctttaaccaggaacgcatgtcccaattggacgattatgaatccaccttccaggtaacccaccgttaccactcagcttcctatgtggcctccattacttccaatcctatatttctgcggaacctgaaaaacaggcacaaaccctttatccaccactatgactttctgccgcatccaagtatttatgcgcccatattctttcaggaaaaactgattggctttctcaccatcatcggccactacatggacctgactcagggtatgctggatttcgcaggtattttagtggaacttctgtcacgggcaatggggtattcaggcgtgactccttaccgcaacagcccagaagataacattctcctgcgccttattaagggagagggatatgatgcccagattgatgctgtctttctggaaaaggcaggcgtcactccggacaatctctactatattgcactcctgcgttttgtacctcatctggatgtcctcataagcatccagcaaaggcttatccaggctttggaacatcttctgaaaagtaaggtcctggcagataatgacaccattctgatactggtacaggataagcgggttccctatgcccagttttccggtataatagacgaattcagcagagcaaatggatttgtagtgggattgagccttcccttccgcggagtggaaaacgcttcctacttttaccgccaggctgcctgctgcctgacatggtgccagtcaaaagactttcccgggacacgatgcttcttctacggccgctttgtgctctatgatgtcctgtcccatttcggtacgtctgctgaactggctgccatcaaacaccctgccctggctatactggaatcccatgaccagaataaagtaggtgaattaaaaaagacaatggaggtttttcttgactgcggcaacgatgtgctgaaggcggcccgtcagctaaacatacataaaaactccctgtactaccgcctggccaaaatttcagaaatgacaggaattgattttgacaacagcgctgtctgttcccacttatgcctctccctatccattgaaaggatgcaggaaatttccacgtcatccactgtgttggagattacataaaatgatttcaataaagcaggccattactaaaaaatcccttgagagcccggtaagctcccaagggatttcgttttatattcagttctctcctgcaatctccgtcacataaggctgattccagtaaaacgccgcaccatggaatttcagcgttacctctgtgtcgccttcatcgtaaaagacccggaaaccgctgaggtttcccttctcatcaaagtcatacctctcattttcccatccgctccaccttaattttctctggcaaatcaggcccctcagcgccaggtccttatcctcatccaccgccttcacatcgatgtaaactgccagtctctctgtcgtcttaagattccccttcacatcctctgtctcttgtatctggggctccttcatcctggtaatgccaaggattcgcacagaaccgtcttcccacggaatatccaggttcaattcttcataatcctccggtataggcagcgtgacaggctgggattccactctgtttaaaaacgtgactccgggtatatgaatctgaaaaggcccattctgctcctccttgggtacgccgaacaggcatctgatacgccgtccatattgttttatatcggacagccggtaatgtcccagattatcccaatagggattggccgtcagctccctgattgaatattgtttcccgttgccggatatggtgggcatatcaatctcctgacgcatgggattgtagccaatgatgacagaccgctcacggtcctcgttgtacacataccaggatatcaggattccctcatctacccgctcacccatgctgataatggaagtaccgtcatgggtgtccagactcccctgttcctgttgcgctaattcttccaaagtcccatattcaggcacacgcttcaggccaaattccagcggtttttcaaaatcaagaacctgcagcgcgtaaccggacaaattatctcctgattcaggagcagatggcagctcaaaccttgcttcgatgatataacgccggcggccatatgcctcaatgtaagcaggataactataataccctgactccaggggcttaattccagcttccggaataccgggacctgtaaggaacagcccttgccctgatttccataactcatcctggtatttctcagaaacaaccatacttccgtcacttaatgtatgatacagaccatccgcaggaggctccccgcctgccgggattttctgtagttccgaatcatcatccagaaccatgcttacaagcagttcctgcttttgatggagggcggatgtcagggatattgtcttttctttttggggcatttttgatacaatcacagtatccagttcgtaaatcggatattccgattggataattccgtattttccggcaaactgatacggcagagcggaaaccaggccttcttctgcttccggctcccgtaccgcctcctgtaccggctccgttccactccccggtccatgccccttctctgtcccatgcttattctctgaaccacgctcgcgctccggctcatgggtcagctccgtgctgatacctggctccggtgaagcctccggcgttccaccggctggttttccgcttgtccggcagccggacagcaaaacacacagcaggcctgctgtcataaaaacagctgcagtatttttcttcatggcagtcctcctctctccaacataatccacatacatttacctatttttatctttgcagaacatctgcctgcattcccatgttattcctctgtttcagcctttatatccggaccaccgtgtcatagggcggccggaacaatatgataccaatgtatttattataccggaatacggtataaaagaaaaggcgcaaagtatactacttcacacctttccgttctaaatttcatcttcagcaaatcccggcattgcttactgcacccaggccccgctctcatccacccgcgacccgtccggtgttgtggtgttggtcagcatagcaccgtccgcacccagataaaaccactgtccgttttcttcaaccttctcccactggttcttggccatggctccattggagcgcaggaaataccattttccatctacctgacgccagcccttggccatatatgtgttggaatcaatccagtaagaaacaccgtctgccgtaatccattcattagcagccttggccccattgtcctttacatagtaccatccgctgctgtcctggacccatcccctggctgaggttgttcccggaccggcatttcctgtaccggaagaaccgcccggcgtacctgtgccgtttgaactgcttgtgttatctgcatttcctgcacttcccccgcttaaagcacctgccttcaccagttcatatccgtaatcgaacaaggccttggtatccgtataatgggttgacttgctcttcatgataacggcaatcagtctgaccccgtccttctccactgcggtcaccagggtatttcccgctttggatgtataaccggtctttcctccaatgacccccggataatatctggcatcgttgggattcagcatcttgtggcccattgtcacggtcaggccggaaggattctttatggtagcaggcagtgcgtatgtacgtgtggacgccactgtctttaccacatcattctggaatgccgcccttgcaatcagcgccatatcatggggcgtggtgtaatgattggaatcattgagaccatgtggattggtaaaatgtgtattggtgcatcctaaggccgctgccttggcgttcatcatgtccgcaaacttagcattgctgccggccacatgctccgcaagggcatttcccacctcattggctgatttgaggagcagggcgtaaagacactgccgtacagtcatcacatctcctgccgtcatattgatggacacggcacccgattccaggttggtggtggctgttgctgaaaatgtgaccttgtcatccagattacagttctccgccaccagcagtgctgtcatcagcttggtgatactggcgggatagaactgcttgtctccattcttgtaatacaggacggttcccgtggcagcatccattagtacagctccctctgatgctatctccggcttctgcacggaagcagccgctgtctggtcaaaggttccggcagcagagcctgctgtctctcctcccggcgatactgctcccccgctgtttccgccggctgtctgtcctgccggcggattaccggatggggacggactgccggatggggatgggctgccggatggggatgggctgccggttgaagacggactcccggttgaagacggactcccggaagtagacggactcccggaagtagacggtccgtctgatgaaatgaccgccccaccactgccggattccgggcctggcccatgggacgatacagtcccctggccggaggtctggtcccctgactggaaggaagatacctggctttcctccaaaggcgtgatggttgctggattagctgacgctgccgtactcataagcagggtacagctggtacatatacataaaaatgatttccatttcctaagtctcataatatctctcccatattgcaggcactcattttttgtgaacaaaactagagatattatatcatacttccaggttacaaaaaacatctatttctgacgataaacttacgataaatatattttttctttaattgcgcagacaagtattttttcttaccatcccccttcctctatactgctataccatttgctgccgttccttatgctgtctttccatatcccccccccccccccaggccagaatgcattccggaaatgccccaaagcattccatcaacaccccctggttcactgtcatccccgctgtttcccgctcagataccgttcaagcatttcaagctcatccaggtaaatgcagttgggtatcctgtgatgtcttaccgcctcaatgcactcgccaagctccatccacatgacgctctccacctcttctttttgaagcatgagatgttctgcatccactggtttcctgtacacatatacggcgctgacctcgctgtccttaaacatccttccgtaaaatatctcttccatatatcccttgtggcagcctgcaaactccaggtcctcctccccagcctcaattcccagctcctccttcagttccctgacagcggacggcaggaaatcatctccggcctggacatggcctgctgaagaaatatcataacagcccggataggaatccttgcactggctccgcttctgcagcagaaggtcgtatattttatcctcattctcccttacaatccatatatgggccgttccgtgagggaccccgtccatatggaccaggctccgttcccggaccactcctgtcctcttcccgtcctcatccagcacatcgaacagctccatctgtttcccgttcagggcggcctccgtcagacggtcccctttatatgccagtttcagtgaaaagaagggtacctcctcattcaacagcttaaaaaagattttatccccctcccacagattcagggacagcacgtcctccttcttcacccactccagcgctccctcgctgcaggctgtcatgtttccctcatatttgtccgcagtgtacagacacatgtattctgtctcccagccctctgcaatgaatgtaaccagtcccctgaaccgccaggaggtaagggtaaggccggtttcttccttcacctccctgagcagacagtcctccgggctctcatccccttcgaaatgcccgccaaccccaatccatttatccttattcacatcgttcttcttgctgattctgtggagcatcagatacgccccctcatgttcgatataacacagtgtggttaatctgcttttttgttccatttccccgtcctcccgttcccatataaaatacccgccggagttcttccgacgggtatcattataaaccaattcttcctgcgcttcaatcaccaggcactctttcctattcctcaatggaatagttgggagcctccttggtaatgtggatatcatgaggatggctctcctttaaggatgcagcggaaatcttaatgaactgcgctgtctcctgaagggtggtgatatcctgggcgccgcagtagcccataccggaacgcaggccgcctaagagctggaatacagtatcctccaccattcccttgtaagccacgcgtccctccacgccttcgggaaccagcttctttgcgtctgtctggaaatagcggtccttgcttccgttttccatggcggcaatggaacccatgccgcggtataccttatatttacgtccctggtacagctcaaaggtacccgggctctcatcgcatcccgcaaagatgcttcccatcatacatacgctgccgcctgcggcaatggcttttgtcacatcgccggagtacttgattcctccgtcggcaataatgggcacgccgtactccttggcaacgctgtagcagttcatcacagccgtaatctgcggtacgccgatgcctgccaccacgcgggtggtacagatggaaccaggtccgatacccaccttgacggaatcagccccggcctcaatcaatgccctggtagcttctgccgtggccacatttccggccaccacctgaaggtccggatacgcctccttaatcatcttcacgcagcggataacattggctgaatggccatgggctgaatccaggaccaccacgtccacctttgcctccaccagcgcgcctacgcggtccagcacattggcggtgatgcctacggcagcgccgcacaaaaggcgtccctgttcgtcctttgcggacaatgggtacttaatctgcttctcaatgtccttgatggtaataaggcctttcaggttgaactcgtcatccacgattggcagcttctccacccttgccttggccaggatggcctttgcttcctttaatgtaacgccctccctggcagtaaccagattcttggtggtcatgcactccttgatggggcggtcaaagtcttcctcaaacttcaggtcacggttggtaatgatgcccaccagctttttgccctctgtaatgggcacaccggatatgcggaattttgccatcaggtcattggcatccttaagggtgtgctccggcgaaaggaaaaatgggtctgtgatgacaccattctcagaacgctttacccggtccacttcctctgcctgggcttcaatggacatattcttatgaataataccgatacctccctgcctggccatggcaatggccatacggtgctctgtaaccgtatccatgccggcgctcatcagcgggatgttcagtttaatctttttggtcaaatgtgtggtcaggtctacctggttgggaatcacttctgaaaatgccggtaccagaagcacatcatcaaaggttatgccttcgccgataattgtacccattataaatttcctctctttctgcgtgtttggtttgatatgtttgtcagaatattgatagtccgcgaacggtccgtttcttattagtatcttatactagcaaattttatctggcttgtcaaaccaaaacagggagaaatattcattgattttactaatagggttccatcagccgtcctaatatccccccgcagcactgtcccgggaacagcaactccgggaacaccgccgccaggagcagcaccgccagaagcactccccgggaacaccgcccccgggaacatcacagccaggtagccagccacaccataagaggcaccgtaacaatggacaatatggtggtcatggcaaagacctgggacgcatacacctcatcccgcccgtactgcagggaaaacaggatgccgatggcggccgcaggacaggaggcagccagtacccctgtcatcctcaccacctcaggcaggaaaaggaaacggctggccaggatgaacaggaccggtatgagtaccagcctgtacagggacagccggaacaccttgggagccctgatgactcctgccaaatccgttcccgccatggacaccccggccaccagcatggccagaggcgtattcatatccgccagcatttccatgggccttagcaccacatagggaagcttccatctcataataaacagggacaggccgatcatgacaccggcaatgccgggggacaccaggcgtttccatgaaaaacagtaatcactgctgttcatgatatatacaccatggctgtacaccagaaggttgaagatagccgcaaaggcattgatgtaaaataccccctcctggccaaagacaccgtatgccagcggaatccctatgaatccgcagttggggtacatacacgaaaaccgggccaccacgtaatcgtaatccctgctctttctgacaatccaggtgggaaccaaaatggagatagcaaagctgacaattcccaaaaggagggaaccatacagtcccctgactgtgtctgccgtaaatttcgtctgaaaggaggaaataatcagggcaggcgtcaccaccttcagtatgaccgcggacagagtcttgctcttttcatggtcaatgactccgaaacggctgcacagaatacctgcggatatgatgacaaacattactgcaatctgtctcagggtagtacaggccagctccatatcagataaccttatccgggttcagaaccagattggggtcaaaggcctttttaatccgcctcatcaggccaatctgcacatcccccagctgttcattcagatacgccctcttggcatatccgatgccgtgctcccctgacactgctcccccatactccctggcctttgcgtacatcatctcaaatccaaggcccagcttttccttccattcatcctctgccagttcatccctgcagagatacacgtggaggtttccgtcgcctgcatggccaaagcttggaatccgcagattcagttttcttgcaacttcatgggtgaatttgataaaatccgccacccggtccctgggcaccaccacatcgcactcatccatctgggtggtggaagccttgattgcttccagaaatgctcctctggcgttccacacactctgttttcgctcctccgtatccacgatgaacacgtccactgccccatggtccagacataggtctgccacctcccggtattccgcctgcacctgctctgcatttcttccgtcaaatgtaagcaggatataggcatcatttctggtatccgggaaccgtttgcccaggtattcctctgcaaacagaatggtcccccgttccatgaactcaatggctgttgcctgtatctgcgcctccacaatcaccggcaccatctcaatggcctgctccatatccggaaacggcacaagcaggctcactgtcttacccggaagcggaaccagcttaagcacggcctgggtgatgatgcccagcgtgccctcggagccaatcatcaggttcagcagactgtagccggaactgttctttactgtttttccgccgaactccaccacctggccggtgggaagcaccactgtcagcgcccgcacgtagtcccttgtgacaccgtattttacagcccgcatccctcctgcgttggtgcttatattgcctccaatggttgctgatttctcccccgggtccggcggataaaaaagcccgttttcctctacatactgggccaggtccattaatagcacacccggttccactgtcactgtaaggttcttccggtccagctccaggatatggttcatctgcgttgtctccagcataatgccgccgtggatggccacagccgcccccaccaggccggtgccggagcctctggtcaccacgggaattccctgtccattggcgtaagccatgatatccgaaacctccctggtggacaatacccgtacaagggcctcgggagcacactccacgcctcccagctcgtcgtggctgtaatcctcgcttatatccgggccggtcaggacccgttcatcctctgtcaccctttttaaataagcgatgtcctgttcatccagtttcctgtatcccatcatacaccctccttaaccgtcttaagcagccgtggaagaatctcataccagtcccccacaaagccgatgtttgcaatatcaaaaatcggggctttcctgtccttattaatggcaatgatgcagtcagctcccctcattcccgctgcaaactgtacggacccggatatgcccacggtaatgatgagctttggcttcacggtcctgccgctgaggccaatctgacgcctggggtcaaaccagccgcattcaatcaggggcctggtgcaggctgtctgggcatccagggcagaggccagttcccttatcatctccaaatctgcctggcttttcacaccccttccggcagccacaatcacctctgcctcggatatgtcaatctcctttggcttgtgtatgatttcctccaccctgattctccggtcaatcatgtcatccgtcacctccatggactggatgacgcccgttggttcctccgtcacagagggagcagagaaaattttataccgcaccgtacagaactggggccggttcctgggagtcacaatctgggccataatatttcccccaaaggccgggcgaatctgcaccaggtccgtgttttccttcatttccagaaccgtacagtctgctgtgagtccggtacgaaaccgcgccgccaccctgggcgccagggaacgtcctgcattggtggctcccaccagaatggacgagggcctgattctggttatgaaatcagcaaatacattggcatatgtaaggacggaaaaatgctccagctccttcctgtcatacacaaagacccggtccacgccgtatgccagcagttcttttgcctttgctcccacatcatgccccataaaaagcgcatacaccggatgccctgtgaccgctgccagttccctggcctttccaatcagctccagcgtcaccggatggatgtcctttccgttgtattccacgtacacggcaaccgcccgccattcatccttattcatttcctgttcccgggactccagatattccaccgccccggcgggaccctttttcacacacagcctgcacattctgcagccggagtcaatctccacccttccgtccttacagctgatggcgccaaaggggcatatgtcaatgagctgccggattccctcttcatccagccgttcctgatgaatcttcagttcagccacaatcctctctcctttctgtcctacaactatataaactttgcctctttcagcacatggtacatcttatcagccagctcaccggggataccgtcgaatatttccctgtactcacgtttctcaggcgggaatatgcgctccacctgggtgggcgaaccggacaatccgtagtggttttcatcccggtcctccaggtccggcagggtaaattccctcagataaccctccggcagctccttttcccgtttgtaggagggaagccttggcgtattcacatccttatccagtgtaatcagacacggcaaatccatggtctgtatctgttcatatccgtccatatttatgcgcacccgtatccatcccggccctgtttccctgatttccagcacattggaagcatggggtattcccagccactgggcaacctccggccccacctgcgccgtgtccccgtctgtggtctgtttgccgcagagaatcaggtcatactcccccattctgcgtatgccctgggataaggtatagctggtagccaccacgtccgcgcccgcgaatttcctgtcgctgataaggcccgcgcggtcagcccccatgcacatgcattcctttaatgcctcctttgcctgtcccggccccatggtgatgacatccactgtgcctccctgctgctccttcatctccagggcagattccattgcataaaggtcgtacggatttaactttgactgggtcccgtcccgcttcagtactccggtcaccgggtccacttccacattggcggtgtccggcacctgcttaacgcaaacaatacatttcataaatccctctccttaaaaaatcggtgcatgtatcacctgtttccaatacatgcaccgatatcataaatgaccgtaccctattacattttcgtcaattactccatgtctgcaagtaatttctcgattttcttcttgttggcgtcatccagctcgccaagcggcttgcgcggcagacctacatccaggccctgtgcctgtaatgtatacttgcagatttcctgccagtggggaactccgttgaccttatcatagaagaagtaatctatgtatggctggatgttgttctgggctgcaatggctgcgtccacgtcctttgcaaagcaggcatcctggagtctgcggcactgcttcggaagcacggccgggaatcctgacagccagccgtccgctccggccaggaggccttccatggcagcgtagtcatgtccgtagaatacagtcaggtcatccttgcagtggaacttcagttcatgtaccctgttggggtcgccgtgggctgccttgatgcactgtatggttccgtcatccaccagctccttgacctcctgcacgctcagctcgtagccggcaaaccatggattgttgtaaaccatgatttcaatatccagcgcatcccttaaatccctgaaatgctgcataactgcctttttatgcggattcaggtagaatggaaggataaccatgacacagtcggcgccgtggtcctgtgcgaacttgctcatcttaatggtatttaaggtatcgtatctgccggtaccgcataccagaggaacctggccgcctaagaaaccggatacgtgctcgatgatttccctctgctcttccatattcatggcaatgttctcaccggtgcttccgcagatggagatggactgtgcgccattgtccagcagccaggtcaggtacttctccatacccttcttgttgtaagtctggtctgcattccagatggtcatggatgccgggcagataccgtaaggtttcttgattgtgtcttttactttcatagctttctccctttcccccaagttacacttggaataaaaaatttgttttgtgttaatatgtaatattaaattaaaaataaaaaattaaatatttttaattattattttgcctgattctaaattagcacatctttcgttcaatgtcaacaaaaaaattaaatattttttattttcttgttcaccttccacaacagcaggataaaggcagcacacccctttatccgcccagataggattttttaatggtatcgcttctggccagctcttcgctggaggctgtaatcaccatgcgtccgttttccagcacgtaacagcggctggacacctccagggccatgaaggcgttctgctccacaatcaggattggcagatgcttctccttattgattcttaaaaaaatatcaaacatatcgtccacaatcacgggagccagtcccagggacggttcgtcacacatcagaagcttggggtcccccatcagtcccctggctatggctaacatctgctgttcgccgccgctcagcgaccctgctttctgcccccttctctccttaaggcgcggaaataagtcatacatctcctcaatctttgcattcatttcctttttggagcgctttatgctgtagcttcccatctccaggttttccagaactgtcatgttggaaaaaatttctcttccttccggaatctgcaccaccccggttctggttatgctgtgtgtgggcaggttggttatatcctgaccgttaaactccacattgcccttttttaccttcacccagcccacaatacagttcatgagcgtggtctttccagcgccgtttgacccgatgatggaaataatttcgtcatcgcctatttcaagggaaatatcatgcaatgcacagacatcgccgtaataagcgtcaatcccattgacttttaacataagaatccctccgattatctggaatcctgctccacataccggctgcccaggtatgcgcggataacctcttcattgctctgtacttcctttggcgtgccctctgctatcatgcgcccgaagctcagcactgttatgtagtcgctgattttcatgaccacatccatgttgtgctcaatcatgaagaacgagtacccgtcctcatatgctttatagataacctctaccagttcggcgcgctccgacggattaaggccggccgcaggctcatccagcagaatcagtttagggtcattcatcatggcccttccaatctccgatatcttctgacgcccatagggcagattcttcatcagggagcctctcaggtcatacataccgatgcgcttcagaacctcctcggccttttccttaagcctcatttcctccgcccgggcgcctctgatatcaaagattccacgcatcatgcccatgggcgcctgctggtgtccccccaccattacattctccagcagggtcatggtcggaaatacctttatattctggaaggttctgccgattccctgcctggcaatatcgtgggtggtcatgccggtaatgtcttttcccgcaaattccaccttgcctgatgtcaggggcagtactcctgtaatcaggtttacggtggtggtcttgcctgctccgtttggtccaatcagggcgtggatggtgtgctccttcatgtcgatgctgacattgtcaaccgccacaaggccctggaatttttttgtgatttccgtcactttcaacagacttgccattctcttattcaccgccttctgcatagctctttccgctgattctctgatacatcttcatgaacagacctgttgccgcgctcacccagccgtccgggaagaaaatcgctcccagcagaatgatggaacagaatacaatttgatagtaattgcccagaaaacgcagcatttccggaagaatggtgacaatggcagaaccaaagatggttcccaccacggaccccagtcctcccaccatcagcatgaccacatagttggtggacaggtccagattaaaggtggatggattgatgtaacccatatagtgggcatacatggctcctgccacggtgccgaatatggaggccacggtaaacgccttaatcttgcaggacgcaatgtccacgccgctcatctccactgcctccacattgtcccgcagggatttgaaaattctcccccacttggagtaagcaatgcgccaggcaataaaaaaggcaatggcggtaaataccagaaacaggtaatacatttccttctggctttgaatctggaaacttccaatattatagggccttatattgcggataccctgggtgcctcctgtgaatttcggcgtattggaaatcagcagacgcaccacctccccgaatccaatggtggtcagggacaggtacacacccctgactctcaggctgggatatcccagtcccctgccgatgaggattcccatgattaccgccacaatcagacccagccagggcgtcagattcgtgtatctggtaaacagggccgaggaataggctcccagcgcaaagattcccgctgtgcccagattcatctgaccggtcaggccagtgatgaaattcaggcctaaaaccacgatgatattgatgagtacgcggttaaggaccatcatatagtaatcatttttaatgaacagcggcagaaaagcgccaatcacaagggctccaacagcaaaatgcagtgatttaagtttcagtttcatcttcatcttcccttactcctttcacgctttcttgcctaagaatccgctgggatgtaccagcaggaatatgattaacaggacaaatgacacaatatctttgtatacagccggaagaaccaccaccgccaggttttccaccacgccgatgaacagaccgcccaggatggcgcccggcagatatccgaatcctccgatgactccggctgaaaagcctttaaggcctatgctggccgccatggtggtggatatgttgaacaagggtatgattaacattcctataacgctgcatatgatggcgctgaccgctgttgtcacgcagatattctgggccacattgatgcccatcagggcagctgccttcttattctgggccacacagcgcatggccttgcctattttcgtaaaattcataaacagctgaagggctgccaccaccaggatagccaccacgcatatgatgacattggcctttgtgaccataagcgtaccaatcttaatggttccgctgagccagttctctatggtaaagggaacgggaccatatataaggcggatggcctctgccagaatccggcccagcatcatggttcccatgacggcaaagatattggaacgcatgtgccgcagcggattaaagatgccggaagcgattacagagcccaggattcccatgagcatgaaagtcagcacaatggccagtggcttgttcatgttgaacttgatgatgaaggtggcggcaaaaatatacgcccctacggtgatgattttatcatggctgaagttaagcagtcctgtggaattccatatcagggtatactcgatggcaaccagggcatagatgaatcccatggcaataccgcttatcagtagctgaagtatagtgcccatcatttacctccttttcgtcatgacagggaccggatttggattcaggccaggtccggcccctgtcctctatcagtcagaaactattccacagaaacagccttgatgaacttcggaaccttgttctcaatctgtgccacattgatgttgtggaccaagtcattgttctcatcgcaggtaatgactcccaccggcacatttaaatccttaagtcccttgaccgcttccataacagccttgcggtccgttgtccctgctgctttgattccctccagaagggccactgcaccgccgtaataggatgctgcgtataattccggttcaatctcatactttttctcaaaattttccttaaaggaaacaagggttgggtcgtcgctggtggacacataatccgtcactccgtaccatccttctatgtactctgccttgcacatgtcaattacctgctgcatggtaacgcccggagacgacactacctttacatccagtcccagctcgtatatctgacgtgcatgaatggccagctcggcgtcgtgagtccatataataaccgtgtccacgcctgcatccttcatcttcatgacctgaggcgtaaagtccttgtctcccgtgttatgtccttcttccacatactccattccgttgtccgcgcagtactgcttgataacaccctctgcgcctgttccaaagtcgtcattgttaaagaacagtcccagcttcttgcagccaagctcctttgcgtaggctgccgctgcctctgcgaaaatactgtcggaagccctgcagcggaacagataatcattgtccagggtactgatttgcggtgtggttccgcctgtgaaggtggccacccctgcctgctttaccactgcttcaactgccagtgcattggtgcttctgtggggaccaacaatacccaccacgccttcgccaatcagcttattggcacaggtcacggccatgtcctggagtgtctggtcatccacaatggtcagctctatctgctttccattgattcctccggctgcattgtactcatccacagccatctgcactccctggttcatgcgctccccgttcagcggattatcccctgtcatcatggaaataaggccaatcttaatgacatcgccctcatccgcagaagcctccccgccggaacctgcctgggtatcccctgcctgggaacctgcgctgccggaagacgccccctgctgtcctccgcacgctgccagtgacaaagccaagcttacacttaacgcaattgctgcccatttctttaacataataccttctcctttactttttatttttactttttttagttacataatatacttaaagccatcccggatttgttccagaagttccatgtcatcgggaatcgttacccggtgcacatatgcaatcagctcctccagtccctcttccggcacccccgcttcccttatgctgacaggtatccctgcctccctgagaaatgccttcagttcttcaatttcttcctccggtcttccgttgacagccagctggaggggcagggccatggcgacgatttccccgtgaagatagttttttctcacgtccttgtgcatatagcagaccgcgtcataaaaattatgtgcaacagccagctgcttgcctcctgtggacaggtccgataccatgcctgtcagcatgatattcatgttcaccatgtcgtctatgagcatgctgtccttcttgtcatcgaaatccttaagggcctgtctggtatccctcatatatttactgtaggtgaaatccgcaatctttgtggctatctccgaggtggcaatcatgccttcgtccttcaggtgggacatggtgaagctgaattccggtttcttcgccatggcgtccacaatgcccgacacaaaataacgccttggacaatcattgaccaccaaatccatgtccacgataaccccgctgatttcatggttcaggaaaccgctgtggtccacattcccgtcctcgccgtataccacatacagcacagcgtaagccgcacatgtggctgcggatgtgggtatggtaaagatgctggcgcctgccatgtctccggctgccttggcaatgtctatgatgcggccgcccccgattcctgccacaatttcagcccctgattccctgaccctggcagccacctccccgaaactcttctcagtggaaggtccctcaaatatctcccactggaatgtaattccggcctgcctcagactttcctccagcacctggcaggtcttccccctcaccacctggtccccatacagcaggtaagccttcttaccgaaacataccatctcctctcccgcgcgcttaagtgcgccgtggcactggatataacgtccagctcctacctgaatgtgtttaccttcaaacatctttgtcctctccttttaacgcaatttttaatttgttatggcaaaataataaattaaaaattaaaattttttatttgagagtacactttatcaaactaagtgccgggcagcccatgaacgcatgatataaatgcatgaaacatggattgcctgattcttagcttaaccgcaagctttataattcgattattgttttaattacatccgttactgcttcttcttactgcttctggttggtgatgatgtaaaatatgttgtttatatggccggcaatcatctgctcagactgctccacatccttattccttaaatattccaacagcttataatggtcatccaccgtggaacggaaattcctgtttcgcagcggcagcacaaggtaattggccaccaggaactgtccctgtatcctcttatacagctccgataagtactcattccttgccccggataccaggacccggtgaaatctcaggtctgtcttggacagttccaggaaatcccccttatccagatactcctcacactttttggcgcaaatctccaactggtcaatcaatgaggatgggtctccggcctcagaaaggaaatgctcaatggcatgcttttcaatcatcagccttacatcgcagatattcttaatctggttctggtcaaaggtggggaccaccacacgcccgttgctgagcttttccaggactccgtcattgaccaaaagcttcaccgcctgaaccaccggcgtcctgctgacttcatacttctcgcataaaacgtcaagtgagatagcgtcatccatcttgtattcaccgaggataaaactatcaataatctggtcatagataatcttatctaaattcttttttaccctcatctcaacagctcctttgctcgtactatcattataaaggataaaatgaaataatgcaatattaaatttttaatttttaatttatttttgtggctaatacacatccgccccctgtttatttcgtttatgtttagtcaatttgcgaattgttatctttatttcccattgatatactggttatattctataaacaaagtgctgcgctgcgcagtacaagccaacagaacggagggttcttgtatgaaactggaaaatatctcagatgtaaaagcattttttgaagcagtggaccagtgtaagggaaaaatcgagctggtatcccaggaaggcgaccggattaaccttaagtcaaagctgacccaatatctctccattgccaatatgtgttccaacggatacatcaaggagctggagttagtggtgcatgaaaaggaggacatggaccgtctgattgaattcatgctgagcggcgaaaacctgaaatagggcacacaatagggcacacaatggccaaacataatacgggccgccggggcagctgatttgctgtccccgacggcccgttttctcccagccagacgtatatgacattacatcacaagcttgcgcggaaatgtcctgcgcatggctcctatcattctctcattgggttcaaacagtaccttgaaatggtccggtcccttctgatatatgagggcatacaccttggcatcccgcatgcctgatgaaaaatcctttatcttcatgccctgcttctcataatccttaagcacaaaggaatcagccggagccacaatctggatgtcgtccttctcacagtcaaatatcttttttctctttgcctttcccaagatacggtccaccgacaggccgccttccgcaaacagatattcaaattccacgctcaggttcagaaacacaaaataggtggccgcacctgctatggtcatgacaattacgccaaacacggtctgaagtgcggaaagcacggagaaaatacagaccgcaatcattaaaatctttacaggaacagcatatgccggagattttctcttcacaagccactctacatagttatcatcgttcataatgtctctccttttatcattttgcatattacacattatacaatactttatcccatatttccagtaatatcattcttatgccgcaggaaagagagggtctgctccatattttccacagtcctgtgattgatgaaatgctcaattttctccaccagctccagttcatcctccgtgtggttaagggcgcagaaaaagtcctgaagcacctggtgccggtgcagaaggtatctgccctcctggtatcccttatccgtcatcatgatggagccgtactttttaaaatcaatatacccggcttttctcagattatccagcatctttgaggcggatgagggtcttacatgaaggctggcagccagggagctgacacggatgggttccccctcttcctccattctgcacaccatctccagataatcctccatggatgaggtcatttcctcggaaccggagcgctcatatcctttcatggtatagaatccatctttttcagtaaccaaagtgtccctcctgcaatactatatgagtaagaaaaagtttccctatcctaaatctattgcgaggtattgtaattatgaaagaatttctaagtttgaacgatataaaacccgggaaccgggcgcgggtaaaagagcttacttccacaggcagcatccgcagacgtctcctggatatcggcctggtggaaaacacggaggtggaatgcctggggcaaagccctctgggcgacccatgcgcctacctgatccggggtgctgtcatcgccatccggtcagaggactgccgcgggattctggtccagccctgcactggcttcagccaacaggaagcaatggagggctgcaccagcaccagcctgtgagccgcccccaaaaactgcggatttaagaaacatcatctgattccggtcagatgcagaattgcctaatataaaaaaagaaaaaaggagtattaaaatgggtctgaccaaacaatccgtcggaatgggagctgtggattccggactggagataaaaaaacagacacctgacgataaaataatcgccatagcaggcaaccccaacgtaggtaaaagcacccttttcaacaatctcacaggaatgaaccagcataccgggaactggccgggaaaaaccgtgaccaatgcccagggctactgtaagacaaaggaacacagctatgtgctggtggacattcccggcacctattcccttatggcccactccgccgaggaggaagtggcccgcaacttcatctgttttggcggaagcgacggggttgtggttgtatgtgacgccacctgtctggagcgcaacttaaacctggtgctgcagaccatggaaatatcggaccgcgtcctggtatgtgtaaacctgatggatgaagctgtccgcaagaatattaccatcgacctgaagggactgtctgaaaagctgggcgtaccggtggccggcacaattgccagaaaaaagcgcagccttgaccagctgatgaaacagctggatgacctggtggaaggtacccggaccgcctccccctatcaggtggagtactctcctatcattgaacaggccattgccatggcggagcctgctgtaaaggacagggtggagggaaaggtcaattcccgctggcttaccttaaagctcctggacagtgacccgtccctcatgaaggaattaagggaatatctgggtgaggacatactggatgtacccgaggtaaaccttgccctgtcgcaggccagagaacatctggtcaaatacggcattaccaatgaaatcctgaaagaccgcattgtggctgccctggtggcgtcagcggaaaaaatatgccgtgatacggtccagttccacaaaagcggctacaacgaaggggaccggaaactggataagattctgaccagccggttcacaggctatcctgtcatgataggcatgctggccgtggtattctggctgaccatcacaggagccaattacccctcccagatgctggcggacgccctgttccgtctccaggaccagctcaccaaagccttcatggccatgggcgcgccccaatggcttcacggtctgctgatactgggcgtttaccgtgtcctggcctgggttgtctcggtcatgctgccgcctatggctatcttcttccccctgtttaccctgctggaggattcgggttaccttcccaggattgcctataatctggataaaccctttaagagctgccatgcctgcggcaaacaggctttgaccatgtgtatgggattcgggtgcaacgcggcgggcatcgtgggctgccgtatcattgattcccccagggaacggctcatcgccatgataaccaataactttgtgccctgcaacggaaggtttccgccaccatacaaagggaaacaaaattgttcctcggcgctgacaatgaagaaacagccgaattaactgtaccaatatatggctttggtgattgggctttaaaactgaaggcctatcgtaaagagaaccatgccacacaacaggagcttgcacagcttatgggcgtaaaacttcttactcttcgcagctgggaacaaaagcaagcaaagccgccttacaatatatggcggcttcacaaacacttatttgatgattccatcaaactcacgtgattttaggttatccagtattttatcaatgacggctattttttcatcggtcgttagattagaactgtttagcctgcgttccaccacctctaaatggaactcattaattttatcggaaagtgcgtgaaaatccattttgtcaggaaaatggacaataaccttctgaacgcagttccttttcactcacgctctcccttcgataaataccagtcactttatgttatgaaaatatcggtatgtcctattacatcttatgaagctgttccaatctggcacagcttcatttttaagctataagcaaattatatttgagtcctccttcaataaagggtcatatttaatcgtgccatataaagtcaaaaccatgccgttttatattaagatgatttttttcatttgatttacattattaccatactctgtttttctctttcctccaggaatatccggtcaaattccggttccacatccaaactgattttcaaagatatattaactgctctcatatccctgctatccaggtggcctatgtactccttcaatctcgatttatcaatagtacggacctgctccagcagaatcatcgaatttttctgcaaaccatatttcgtgctgattgccacatgggttggcaatggatgcttgtccatccggcttgtgatagcagcaacaatgacggtgggactgtaacggttcccaacattattttggatgataagtaccgggcgtacccctccctgttcacatcctactaccgggcttaaatctgcataatacatatcacctctatacatcatccataccccctttcttctgctttttcccttatgatgtttgtgacctaatctactccgtactctcttcctccctgctcaatgccacatccatgcagccgatttaaaccggcggctgcatggtctggcattgaaatcaccttctttccaactttgtttgttgcttctattcgacactacttcccgaagcttgtccagacattgcatctggacagggcagccaacccgtctgcctgcgcacgaaatatggtttgcagaaaaattcgatgattctgctggagcaggtccgtaccattgataaatcgagattgaaggagtacataggacatctggatggcagggatatgagagcagttaatatatctttgaaaatcagtttggatgtggtatcggaatttgaccggattttcctggaggaaagacaaaaacagagtatggtaatgatgtaaattaaatgaaaaaatcatcttaatataaaacggcataatagtacgaaaattccatacacagatattaaactattatgattgtccaatcgttataagcgacggttttaaccgaatgtacaaacagtattaaacgtgaaaacaatttaaaggagcgtggtgttacctttgagatacttagggcgcgtacactgtattgtaagacacatctgcagaatacgatgagtacgggtctaacaattggtccagctattaaaacagtggaagaaaatcttgaaaaagtatatggtcagccattttcagctagatgtacctgcgtacagcaggaatattttccattattccaatgaagtagttccgtctattatggaagcaaataggtatgtggacgaacattttgaccaataccttgtcagcagtgaactggtcagggattttcatttgagcagaagttatttcagcatatgcctcggaaaaattgtggaagtgctgttcaacgagtatctttgcatgtttcaacgttctccctcattgattctggcgaaaaactactaacaaaacacgctttctctgctatttcctgagcggtaggttggatttgcgcccaactcggaaagcgtgtagatcttatccaaagcgctgggtaacaagacggttccgtccggatttatcagctggtgagtggtgagcgtgttgtactaatgtcttatatccgtttggaaggtgtgaggcatgacggaggcatatgaaaaaatcagtttctaggcaagtaggaaacaatagaacagtgatggtgttgcgctagttgcagagatgtgtctggcgctatttaatagttgatattgtgctatggatatggagaattaagaaccacgagattttggaatacagacaataataacaacctatttataaaaatagaggaggagtttatgcgagactgtttgggagaaagtcagattggccaggagctaccgggtaattgaacggtttggaaagtatattataaaattatagactttacgtttgagagtttgtcagccctttgacctccagtatctcctccgtttgttttatttcacattgacaggtgacctgacaggatagtttaatccatttttgctgaaccggaagaatgcatttgtagtaagttgattaccctgatgatggtttaaaggaattcatgttaacggatgatgaggtgtgagaggagaaggtcagctatgaagaaaaaagtattgggtatgttacttgcttgtgtgatgatattgtcaacaacagcctgtgcgccaaaggagaaacaaagaaccatttattctggataatgagcaccggccgcactcccccttgttcgcaacctactatggggcttaaatctgcatagtaaatatctcccctgcataatgggacttgtgccagcttagaaatcatcccttttcctataagattataattgggatcttccatcagctttattcgccggataggggcttccaagaatgtgagaaagttttttatcaataaataaatcgtaggaaataataatttctactttaccagggtaattccctttgttgagatatgttccaaagatgcctcggacggaataagtacagttgaccgcataaacaaattaaggtaatatagaaataactaaacaatttgattagaggtaaacaatattcatgaaaataaaggcagttgatattgcacggcaattagggatatccaaagccacggtagttaatggctgctacaaacattccagctacggcagagaaggagtatcgtctggcctattctaattatctgattgaggaggtggccaggctgattggaggacatagctatcagatgttggcccccaatatgtagattccatacaggcgaaggcgaatttcttgaaagagcatagtgagagggaagtaatggatatggtgaaggacgcagacgtggcggttatggggacagggactgtggaccagaattccgccctaatccatgctgacctgatttccattgaggagtttaaaagactgcagaaagaagtggtgacactaaaactgtgagggggtgtttccatgaaattagttagtccgagaaccttgctggcatctctgctgggctgtacatttgttgttatgaaagttatgacctttgctgggctaccggatgtgttttggatcatatacattggatatatgtctgtcaaaggactggtcacggcattttctcagaaagcctatgacaaggatgtgaaaaaggcgcgacaaggaaaagttttgtattgtgacctgtttggaaaatttgcatacgttgcggcagatatcccgtttgtcctgatccttttagcctgccttttggctatggtctgtcccgtaacaacgttgctcagagttatcttgagtgtacttttgttgatagcgttgggatatgcgatctggttgtgttggtatgtttcaaggcataaacggctgcgtatggaaaatggtgaatgggaggcagggattttaagcgcagaagatgagaaagcatggaaacaatcagacctgtggcacagtattattcttggaattgtcgtggcattgggtgctttttatctcattttcggagatcccagaatctatctgaataacgccaaactgaaaaaagcactatctacgctggacagtgacagcgctactctggaggaggtcgttccctttgaatggacatctgtatacacatttgatccctatacatcaatcgaccacattgagtgggtcaccggctcaaagagtcccgcactgaaagaaagcgtcagtgagggcatgacccatgttgtgtttacaaacagagggcaggtagtagccagtgtctgcgcctaccccacaagtattgggtattatttagaatttactggtggagaaaatacatattatggctatctggatggtggatattcccacatcgaatacggtgatgagattgtctttgaagtaatgcaggatgaaggatttgtcaagctgtttgctcgtgttgcggaataatgtatgataccgcatatattataattaagccaagcagatgcgcctttccaagtccgcgctgggcagttatgaagcggatgacttcaaggacatcagccactatgctctgattaagctggcgaagttttacggtgtgaccgccgactaactgctgggattgactgaaacaagaaatcacccaaacgccgatcttgcagacctgcgtttgagtgatgaaatgattaacctgctgaaaagtgggcgaattgacaccgcccttctttgtgaactggcggcgtactcggattttgtgaagctgctggccgatatacagatttatgtggagggcatcgccgccacgcagatacagaacttgaatgcttgggtagacgtggcgagggctgaaatcgtagagaagtaccagccgggagagcatgacaagaccgctggtgtcctgcatgccgctcatgtgcgggagggtgactattacagcagccgaggacatcatgatattgacgctatcatggaggacatacggcaagcccactgataaaaggcgtacttgaaggcgggagtatccactggcggtgcttacagagaccggttttcatcgagagccataaattacttggaataaacacattccggaatgggaaaaaccgtttataatgttaatatagaagcgttttgttgtctgtatgccagactgggatatatagggagaacgagttatggaattcacagtgatgcatatggatgagccagtagcaattgtaagtctatcggaagataagaagaaggtggaaattcaaaaattgattccggattgcatcaggcagccattttgtggtaataaattagatctggaacgggtttacaattttttaaaggaccgttgctacgaggacagacgcagtgaccttaaagaaatactcaatcaggccggtcttacttataataatccatggaaatggattcagataacacacggagtcacatatgaagatttgttctggattcgttttcctggtgagacgataacatggaaggacgtgaaagtgagatgagcgtaaaagaatacagactgagcccgcaggccctggtgatggtacagggaagttcaaagggaacacagcccaagtattatgagagcggatattggtataaagtaaataatgtggggtatgaaggttactcggaatatcttgtctccagggtgctggagtgctctaatgttgatagttatgttaaatacgaacaatgcacgattaatggaagggcgggatgccgctcaaaaagttttattggagaaaaggaatcattcctaagctttcagaggctgtatgacctgcttactggggaaagtttacaggagagaatacgtttaatatcagaggtggcagaccgcattggctttgtaagagggtttgtattagagaatacagggtgggattgctcgatgtatttatcacaaatattgacgctggatatgcttactttaaatacagacaggcattttaataatttgggactaattgtggacgcatcgacgggagtttataaagcggcgcctatttttgataatggaaattcactgttaagtgactgggatcgtttcgacgaagaaacagtggaagagaatcttgaaaaagtatatggtcagccattttctgccagtttagagatgcaggcccgtgaggcaggaatcgggttgatgattgattatgaaaaattgcagtgtatcttagagaaagaacctgtttccagaggtttggaagtattaatgcatcaactgaaacgttattataatataataccagattataaaatgcagcaggagaatgaattagagcaagttgctccagaacaaaaactctagatgcattgatgaattggcagacaggggtaaacagtttgtagcattcttttagcgtgatgatgaacgagatgacttttggagccgataaattcctgttttgaatgcgaacgacatcagaatcgccgattataagggattatatcaaaggcagggagtgtatgaaaatttttctgtaaataggtattagcaaaaggtcttctatgataaaataaaaaatagctacttttgcgccactttcaacactgatttttcagggacggagagccgggaagccttgattttacagggtttttcggccctccgcttattttttgccggggtgcttttcgctgaaatggtgcccaaatggtgcccacatttaatgccgccccttgcggggctatgaaacacggtgagaagatacgccgtcacaagctcatttcccggtcttttttcttggccggggccgcccgctcttgcttgggcctatccagccggggggcggggcgtatggcggcgtggtatgcgtccagcacctctttcttgcgttccaggcgtacatccacataacgggccgtgaccgcttcaaagttcatggacaggcccagggaagccccgatcccggccagcgtgtgacccagcacctcgcccaccgtgtagaagtccccggtgagttggtgcatattggtggccgccgtgtggcgcagatcgtgaaagcggatatggggcatatccagcccggccagaagtttcccgaagccgctggaaatccagttggccgcctggggcgctccgtcggccttacagaccactatatcgttgtcatagtatggccgcccctcttgccgggcggcttgcttgtcggcctctacacgggcaagctggcgttcaaagaaaggccgggccacttccgtaatggggagccgccgcccgtttgacttgggcggggccatgtcctgaatggtggtggtatggggcggcaccttgaacgggagctgttccaccacgtcaaaggtgccgttttccaaatccacgttgcgccaccgcagacccaaaatctcggagcggcgcatcccatacaggccgcccagcacaacgggcatttcccattccgtcccggccacccgctccatgagggagcgcacctgatccggcgtatagggatcgggggttttgtcccccttgccaaacttggtaatggtgtcgcgggcggcgttggtttcaatgtaccgatatttccgggcgtggcccagggccacactcaacacccgcttggcccccgccgctgtactcggtttcagccctttgtcaaggatgtcctgaaacattttatccaccgccgagggggctaattggtttagggggatatggccgatgtaaggtacgatgtagcttctgatcgtccgcttgtacccgtcataggtggagggccgcaggtttacccgcgcatagctctccacccattcctccaaatagtccttgaccgtctgcttgcgctgggccttgaccgtggcggcaaaggtgggggcctggagcttgctttttatggtggcctcgtgctgtaatgcctccttgcgggtgagaaagccttttttcgcataggtggattttgtgccgtccggcatggtgtacttgacattcacatcatacaccgtcccggcgcggcccgtcaggttgccgctggcatcccgtttgtttttgacttgtcgtgcgctgaccgccataggctacgcctccacacaggcggccaccctgtttcgggtgtaccaatcccaaatagcagcctcgcagagcaggcggcggtttccgttctggacgtattcgatctggccgctgtccatgagttcgcggagcttatgctcgcccaaaccgctgatcttactcatttgttccaccgttttcagcaacgggaacgcctgatggacaggcggggggctggtctttttcaaatagtgacctcctctctcagatggtaaaaaatatggtttagagcgtttcccgccgtcccgtggggaaacgtcaaagggcggcgtaggattgaccgcgccgccctttgaccttcccccacctctggcctggatgaccagaagcaggggcggtgcttattccatttcaatccgaaaagtagggggccgccgtaccgggctaatttggactgtcgcaagacagaaaggccccggatggggcggcccccctcgttttatctaaacgcgccgtatttgccacgcatccccggcgcggggaacatttcaggccgccggtggccccggctgtcatagcctccgcctgtaccgtttcgcccgtggagggcggcgcatacagcagggactccccctcaagtctgtgggagggcgtgagcaagtttcattatcccccgcgctgtcctcgcgcccggcttgccagggccgggtctaaggtaggcgttgatcgctcggccagcttgtccatcacctcctgaagctggctgtcctggcggcgcaccttacgtcgctaatcacgcgggttttgtgcctgaaatgctgtgtattcagttgtcatcaggaaagagggcttgtacctctctctatccattaggcgggttagaggccgtttgttgtccacctcagagggatttttccaaaatatttttcagcctttcaagcccgcgctctatggagcggcagaccacgctccgatccacgccgtcggcccgcgcaaggtcggccttgctgatcccgattatgtaatgggcatagacgcgccgggcctggacgggcggaagctgtgcgatggcggcgtagagggcggcccggagttcccggccctccacgatttcctccggggtgaggggcgggcggcagacctgggcctcgtagcctgccacggcctccagggaacactcgtcgttgtcacgcttgcggcgctggtagctgttgcccaggcggcccccaatggagagggtaacggcgatctcgtcggtcacggccaggggctcggacttgggcagatatggataataccgtttcaggtagatagttgtcatttgtacatcctccatttctgatttgcgcggggaaccgggaaaactcagaaatggagcggcggggaacggcacccaggggagccgccccgcagctctggccacgatggccagaagtgggcggggccgggccgctggggaaactggcagaaaaaagtcggatggaaaaacgccgctctcccccacgggaaagcggcgtttgccgggcctcggtgatattcagcttttcttttgcgttgcccccaaagccctgccaatgcccgcgcctccctccgtttgggagggagtataaaatatcaacatttcggcaggctttcgggagcctttcagcggtttaacaaaaaacgcaagttgcggcagggtatcagaaaagcccggctggtttgacagccgggcctccgatcagactttttattcctttttgtgcttggggtcgatgaagcggtagccgatcccccggacgctttcgatgcagcgcccatcctccagtttttgacgcaggcggctcacgctgatggggatggcgttgttctcgtcgcccatgaaatcatcgccccaaacgtggtagcgcagttgttcatgggtcagcacccgccccacatgagaggccagcagatacagcaggtcgaactcccggcgggtcagctccagctcccgcccgttgtagcggacgcggcgggtgtgtgggtcgatgaccatattctcgaagttgacgatggtgtagcaccgctggccggtcagggcggcggcggcattgtagcgccggagaagggcctgtgcccgcagcaggcactcccgaagctccaggggcttttccataaaatcgtccgcccccaggcggaaggcccgctccttgtgttcaatgccgccctgggaggacagcaccaggatcggcatatccttcatctgccgcatgaagcggagcagatcaagcccgtccgtttccgaaagggagatgtccaggatgaccaactggaagccgtggcgcatgaggcgctcgatgccctccaccacggaaagggtgtaatacgcgctgatgccgtattctgtcaaagcatatttgatggccttgcagttttccagatcgccgtcgatgatcagaacgcgctgctccgtatccattgtacagtcctcctctcttttaacaactcacccacttctggccacactggccagaaacacctgggttatgtgtgtgggatcaggaagttcgtccccgttccgccggtgccatgcccagtttgagggacgttccaaacgccggagctgaggttgtccctatcgggttcctattccctgtggagttggttattgattttctgtatttttctcttggcggagaagtatgccccacaccaaatggcggcataaatcaccaccagcacgataaccgaagcggctacgccgccgacagaacggggcacccagtacagaacatatgcgacaatggtaaaggggatagcgaataggcagaaatgcgctccagtctgctttgccaagctccacctgtcgagttcccatatcaccgatgccgcgcctacaatcgcgccgaatatgccgagcaagaccgtctgcacgataactgcggattgttccccgccaaaatcattcaccaattcgggaatgacggcgtaaaacgagccgtcgccttttacggcggatatgacgattgcgataagctggcctaacgcaacgccggcgagcagaccgaaaagacttctgaacaatacttttttcttcattaccgaacacctcctaaatccctaatgcttgtttgattttggtgacataacgccttgaaacataagcagttgtatgattgttcagctcaacgcaaattgtgccgctcatgcttaaatcgagccgaacaatctttttcagatttacaatttcagaattggagatacgcacaaagagccgcttgttcagccgttcctccaattcatagagcctggggcgcaaaagatactcgcggtttgccgtttgagcatagaccttttgatttgccgcatagatacggacaatctcactttcttccagcagccgaacctcgtccccggaaaagcccgcgatgacatttgggtaagatgtggataggctttgcacaagagcgcctatttcgtccgtcattttgtcggcaacaatgatgattttcgggtctttgcagttttcatctatcttcacttcaacttgcattatgtcacctcctttcctctcggctccttgcacttttagtataggaatttggagattgccccgctatcgtttttcaataggtggttgatttcgggatatgggcggctaattttcaagcggcttaaatgcgactgtgataaccgctccctctgtgtcggttgcctgtgtcattgtaagacccgacccttcattgagtacagcggaataaacaacagtttccgaaccgctcccggctgtttcagcttgaattgagatggcgccggtaaaagtcgcttcatcttcatcgtagatggtaaaggtgatttcgacagaaggctcatatttataattttcttctgcctggggcgtccagtaaagggtactgccgcttgggagtgatagctgtttgccctgcggataagctgtaccgtcgtggtcttgatagcctatgagggtgccggtatcgcattctgctttaatggtcgaatagggcaaatcaaactgaaacggaaatgcggggagtttggagcttaaaagcggctcatattcccacacaacattggaggtcgcgcttgtatccggcgaggtgttgtcgctgatcgtccattccccggtttccgtgtcctgggtcaagtagaaatactgctgcgtctggccgtcgtccataaaggtctttgtatggtcgtactccacataatagtctgcatataccacaacaaagtgttttgccagatactcgtccgtccagccccgcgcttgggccagttcgctaccggaatacatggccgcgacacgcgccgtttcatcttcatccactttgatttcatcgacacgcacgctaaccgtatattccttcccggcttggccttcaatcgcactttggacggtttgcaccggatcagcagacggcttttgcagccacgggtcgaaccagcctaactggtatgcggcaaatccgcaaagggtcagcagcgcggcaatcaccgcgacgagcgccagcgtccgcttcatactgcgggcttttttcgttttactcataaaacttctctcctttgcctccataatgtatttatcgtcaatcgttcccaatgcgtcaagaatgtgacttgcgttcatgccactccctccttttttagatatgaaagcagctttgcccgggttctgtggagcatggattttactttgctggtgctaaagcaaaagtctttgctgatttgctcgatagtgtccagataccagtagcggcagaggaaaacttgcctttccgtaactggcagattggcgataaagcgattgagcgtttttgacagctccgccgccatgatttcatcttccaccatgacatttgacggcacacactccgaaagctcgtcaagagcaagggacacttcaccgccgccacgcttgtcccggtggctgtcccgccatttcttgagggatacgcgccgggtaattttgccgaggaaagaacgcaggatggacggacggtggggaggcatggcgttccacgcaccgaggtaggtatcatttacgctctcgtccgcatcctcctgatcgcagagaatgttatacgcaatggcatagcagtatttcccatactttgacgcggtttccgtgattgcgctctcgcttcttgcccaatataaatctacaattcggttgtcctccatcctgccacctcctatggtctatgtaagggcccttcacttatctacttcccgttttttgtgtttggttgcattagaatataaatttttttggaagcacaacgttatttacattcctattttagaggatttgcgaagtatagacaaggttgccgtatagaatatagtacgggggagcgcgttagcggcaagcagggcaagtgtatagacacttgctattttcgccccgcgaaaatgcttgttggggtgcccccaaacccgctggtacttctggccaggatggccagaagtaccgttgtctgcggccccgtcgctaccgctcctgggccttattttcccgcccgtccgtcaggccgagcagatgatccacgttgcccttgacggccaccagctcccgcatctgccgctgggcctcccggtactcggtgtagagggcctttttcttttcggccagctcccggcgggattttttgagcgcgtccatcctggggagcttggccccgcccaggatgccgctgatagatgccttggccgcccggtaggtggcaagctcggcctcatgctgggccagatacttcttgctgtaccgggcggccttgtagccgtcgaacatgggccgggtcttggcatagtccaccacggcggccatgagatcggcggtcttggagatctgggcctcggcggcctgtatctccccggccagggcgtgaaaacgctccaccgcccggttggtctgcgcggccagatcgtcatagtcggtcagcccatgctccatgagatactggagggcggcggccatctgcttgaggttgtaaaccttggcccaccgctcataggccgggcctttgccctggcacattttctcctgaatgtcgatcagcagatcaacgcgccggggggccgggcggggccgcgccgggccgctcttgcgggcgggggccttgccgtcgatgacggcccgcacgtcctccgggccgtagccgtcccccagggtggaggcccggaaacgggaggcccgctcctggccggggacacggaacgagatcgcgccgccccggccatgcaccacctgaacgcccgcggcctccacacgccccaggaagtccgcaaaatcggcggggcgctgggacagggcctcgtcgatggcccggcggatctgctccttgtaggacgggggccgatcctcccccagccattgaccgtaatggagaaagcgccccttgctgtggagcttgggatgctcgatcacggaaaggctatgctccaggcacacccggtcggacagccgccgcagggcgctggccgatctgaaaaagtcccggaacttccgggtacagtccagggccgtggagttgtagtaaatgtgattatggatgtgctgacggtctgtatgggtggcaacgaaaaaggcgtgtttgccctttgtccagcgcagggcggtttcatagcctacccggttcgcctcctccggggtgatctccccaggtgcaaaggactgccggatttggtagcacagcacgtcggcgtcccgcttttgctcccggcctgtgatggccttgtactttgccttggcaagcaggaactcggcgtcggcggtcaggtggtcgcactcatagcaggagatcagctccccgccctgggttttgtccgggttctgtccatagtcaaaccgatcccgcatagactgcgcgatggtttcccccttgctgatgtggtgggtaataaggcgcgttgtggccgtgggcgttccccctttccatgagaaaggcggcggccatgaacagccgccgcccgcttctggtcaggctggtcagaagtcagcccgtgatgaagctccgcagagtgtagttgagatcgtccagcctgtccaggagccactcggccagggccggaagtccaaagggcgagatggcaaagcccatcaccagcagggcgatgccattgaacatatccccctggacggccagcatcagcaccccggccccgcccaggaaaaaggccaggacggacaggactccggcggagagggacagcaagaacgacaggacggccacggtgagcgtcagggccagcacaaagggggcggcgataattttcagtatgatccgcatttgagatacctcctatttcctgtatatgtctattgtaactccgccgaaaatcaaacgcaaggatgcctccggctctccctgcttctggccacgctggccagaagtggggacaaccggggagcggctggggccgctccccgtgggtcaaagctgtaccacgtcggccagctttttgagcagatcggagagcggcccccacagctcggcatagtctttttgcagggccttgatctcctgggggtacacgccgtaggtgttggcgtggatcgccacctggttcagattgttggcacaccgccgctggagggaaacaagctcctggacgggggcaaggtctacgttgaggatatagccgttgagggccattttgcggatataggcgctcatgttgcgaatacccgcctgggccatgcgctcccggatggcctccagctcgtcgggccgcacccacacatagatgggcacgtcccggacgcgctttttcaccgctcctcccgttcccggctccgcctgcggcggggcggctctttcaccttgtccagcggcttctccggctccgggggcagggcgggcagattgttgatcaggccgtcgatgtggttatagttctgctccacggtcagctcggtatttttcaaagggttgttttccatcttgacctcctatctgtcgcccttgtcgggcgcgtcctttttggggcctggcttcccccggttctcctgggccagccgtccggcctctttgagctgttccgcgatgggcggctgcttggcacgggcggcccgccgcgcttcaatcagccgcacacaataggacaactgctccgggggcgtggtgtcgagggccgtataagctccttgatcagcgtcccaccgggtaatccgctgccattcagggcgtttttcttcatcttcccatttccctacaatttgcgtttgctccgcgatccgtttctgcaagtcaggattgtgaggggatgggcgcagctcgtagtcggcggcctctttttcggtcagcggcttggtgtaggtcagatggccccaggcccggaacgtgcctccctccacggggacgcgctgatcgtagttgacgatctcatccggggcgttgtggggcggtttcggaaatgtgccgatgtccacgggccgctgggtggaataatacttgtaaaggtcgggtgcctcagtctgcacaattttgacgttataaagccgctgatagtcctgcacccggcctgtcaggtcttgctccagcgcggcccgatcatcgccgtagtgtccccactcatactgccgctggcccttgtcatcgtcataacaggcccaggttacatagggggacggagcggcggggttctcccccagggcaaagcccctgccgttttccagcataacggttttcagtatgacatagccttgatttttgtccatagtgcctcctttcaaaatgtggacagcatcgggcaaaaccggggcgggccgtgaaatcatacggcccgccctgtcagcgcccctggaaagccttgcaacaagcgggttcgcaggggcctaattgtccacagcccggccccttgccttgcgcatgaaatcccgcttttgcctgcgccgggcggcctgggcgcaccgctgggagcagtacgcctgccgcccgtccggggggacggccctgccgcacacggggcagctcttgaaatccgggggcgggccgtcagcggccagggccgcctccagcgccggatcgaggggcaggacggcctcccggaagtagcggcaataggcccccgtccagcactttcccagcatataacactcgcagtccaggggcagacagccatgctcccggtcatagttggcgcaccatttcaccaccagggcgcggatcgccgcccgttcctcgcgggtcagttcccggctcattcctgcggctccccggcgtcgccgtcctcgtcccaggggggatcgtcgtcctcgaagtcctccgggccgtcgtaagcggccccgtcatagtcctcctccgggtcggcggcccgctgttgcttggggcggtaaatcttgaaataccatccggcccctccgccgatcagcaccacggccagcaccagcaggagcggcccggccccgcccttggcctccggctcgggttccggctcggttgtgggttccgggtcaggctccggctccggggcgggggtgacgggggcggccccctcggtattctccgccagggccatcaggtcggccacggtgacggcgttcaggaagtagacgttctcggcgcttttctgcctgtcgatgaccagatagaacaccgcctcgtccgccgtggtgatggtgaaaaactccttgccctcgtcatcggtggcgttgtccagcaccgtcccctggccgtccggggtcagggggttcggctccggggtaggctccgccgggtcaagcccgtcccacagctccacgccgccggtgccgtccccgtaggcctcgccgcccccggcataggccggggtggcgaagccgcacatcagaacggcggcgcacagggccgccagcacacgcgcttttctcattccgtggcctccttttccgcaggggcggacttctggccagcctggccagaagcgccccggagcttctggagcaggaggggcagctcgtccagagggacgctcataccccgcacgatgtccacgatctcctcgttttccgcctcccggtgcttctgctccaattctttcagcttggcctgggcctcgctgatcttggccttgactttctccatctcggccttgattttcgcgcttttgcttgtcgccatgtaaaacctccaatcatggtaaacgcccgtaggcgaagaaatgggcctgccagtagctactgttcaggttggaatattggatggggtcgccacagtggagcatgatcccgtcgcccacatagatgccgcaatgggaacagcccgccgtgtcgtaggtgcccgtgaagaacaccagatcgccgggccgggggttggaaacgggggtgcagatgttgtataggctggtcgcccccaggcggcccacgtcccagccggaatgattgatcacccacgacacgaagccggagcagtcaaaggacgtgctggggcagtagccgccccacacatagggatagcccaggtatttttccgcctcggtcaagatggcggcaaaccgctcgtcggccagatactcctccggcacctcgtattccgggggtgggtcgttgacgtacttccccacataggccgactccgggaacaggtcgggccggttgcccagggtcgccataaagagggcgtaccgggagagcgcctcctcgcccatgatgtagatgggcaaatgggaaaggttttcgttggagagggtgacggtgcagatgtagtaatcgtagtacacccggtagctgtcggtatgggtgttgccgtcctcgtccgtccaggtgtcggtttcgatgtagtagcgccgctcctttaccacgttctcggtgagaatgtactggcggtcaaagagcatttgcagggtgccctgtacctcgtccaccgtccaggccccctcatggagcgcggagaggatggagagcagcacataggggtcatgctcgatgtcgtccaggtcgtaatggtactcgtcatagctgtgggtgctttcgtagctgtccaggtagtcccgcagctcgtcctccaatccgcagtaggcggcctctgccccccgcatatccccatccccggcgggataggtgctggcggccaccgcgcccacggtgccgtttccaatcgacaccatagaggacatacaggactgcatcaccaccaggagcaggaggcaggccgccaggatcagcgcccccacgggatgccgtttgacgaagcccgccacagcccggccgccgcccgccgccgttttcccggcggccttggcgctctgcttggcggtttcccgcgcccgcttctgatactgccgtttcagcttttgcttgtgccattggcgggagagggcgtttttcatagcgtccgggtgttcctgggccagcttgcggctctggtagtccgcctgggccttgatatagctggactcggcgcgggcggcggcgcgggccggttgggtgcggatgcgctttttcacaaaccgggccgtctttccgaccaccacctcgcccgccagctcggagcggtgagcgccctcggtgcccacgttttcctgctccacctcgtagagcttgccatgcacaaagccgtgaacgccccggccagccgtccggcccacccgcttcacggggccgggcttcttgggcggcttctggtttgccagcttgtcgcgggccgcctccagcttgccgccccgcttctccatgcggagcttggagcgggttaatcgctcctggttgctctcttggcgaaacttctggccaccctggccagaagcgcccccggcggggttactcgtcttttcgttcatgggcattgtcctccggcttggtggtcaacagggtataaagctcggtgtccttggggaaacgatccacaaaggggatggccgtgtccccgtagaacaacaggccctcgccggagcctgaatgggtgacgtaggagagctggtgaggcgaaatccccaggtggctggccagcacctcccgatccccggcggcctgggacagcagatagaggaaatcgcagttgccgaaaatggactcgatctcgctgctctccaacaggcttttaacattttgggtaatgccgctggggatggccccccatttgcggaaacgccggaaaatctccacgctgtaggccgccgtctgcgggtcggacagcagcacatgaaattcgtcctggtacacccatgtcgcccggtgcttatcccggttggccgtcacccggccccacacctgatccgtgagaatgagcaggccgatcttcttgagcatcttccccagggccttgatgtcatagcacaacaggcggttgctgacctccacattggttctgtggttaaagaggttgagcgatcccgtgcagtacagctccagagcggaggccacgcgccgggcctccggttccggctggcgcaaaagctcctcatacaagtcctggagaatgggcatccgctccggggccgggtctgccagataggggcggtacacgttccgcaccgcccggtcaataacggtcttttccaccggggccagcccgccccggccccccacgatcaactcgcacagggacaaaataaagtcgcttttcagggagagcggatcttcatcgtcggcatagtccggggtgatgtccatggggttgatgtaggtgccggagctggccgagggggtgagctttaccacttgcccgcccagccgatggacaagggggtaatattccccctccgggtctgcaatcacaatatcgtcctccggccacgtcaggaacacgttgacgatctcccgcttggcggcaaagctcttgccgctgccgggggtgcccaggaaaagcccgttgggatttttcaggcgcttgcggtcggccatgatgatgttgccggacagggcgttcatgccataatagagggcctgcccgtccatgcgcagctcctttgtcataaaggggatgaaaatggccgtggagctggtggtcatgccccgctgtatctcgatggcgttgtcccccaggggcagggaggacatatagccctgctcctgttgccagtccagccgccgcagagcgcagttgtgcttttgggcgatgccggacacggtgaacacctcgttttccagcttctcccgcgtgggggccgtgttcaccaccaggaacgtgagcaggaacatccgctcgttgcgggactgcagatcggccaggagggccgccgcgtccttggagtaggtgatcaggtcgggcggtaaaatgtccgggtcgtagccgctccgggtggccttgcgctgttcctccactttcatcttgtcaatgtcgctgatcttgcccttgaccgttttgatggccttggtctggtcaaccgtctggacgtggagggtcacggtcatttccgcgtccagctccaacagctccaaaaggagcttgtcagacagctcggacgccatgatctgcaagtaggaggcggccccccaggactggcctacccggaacgtgcggccctgccggaagtcgaagctgtccggcacgataaaatcctttgtccccatgcccgtgcggggaatgtcggcccaggagaagcggaacggctcccggcctccggggtggagatggccgtggatggcctccagccgctcccagccattcagggcgcgggcgtgtacccccaggcgcttgaagttgcccaggatgtccgcctccacgcgctccagccggggccgggcctcggccagcgttgcgcagggcacgccaaaggtgatgtacttggagcgcacgatcccgttatttgatcgggcgatctgccgccccagcatccccacatattccgcccggatgctgtcaaaggcatcgtgggccatggggatattcaccttgtagcggctcccgccacgggaacggtggttgacgaaagagagctggaacggcaaggcgctgtcaaagtaattcaggaacgaacaccagccgttgaagatggccgcctgatcctcggtgcttgccacggaatagttgatgtcctcataggcgatggtcttggtatagtagccgtcccgcacccggcaaacgccgtctttgagcatttccacataggggacggtctgctgggcggagagggccgcccgccctttaccccttgcggggccgtgttttgctttttgctttccctgcaatcggttcctccttttccaaaccgccccgcccggcaaagggggcgtacatattctcggtacggtagggcctcacgccggggcgcagaagccgcgcccggacgatgttccgcaccaccttttcaaagggcaggccgtcccgctcatacatcgccatgaaaaaagccgggagcatgacggccagcatcaggaacatggccccggtgttgccgatggccgaccgggccagcagaaaggccggaacgcccaccagggccgcgccgccgaagcagatgagctggcggctggtcaggttaaaggccagcttggtcttgatcttggaaaggtcgttggggatgctcacataggccatgccgcgccctcctttctgttgccgcccacctctggccagcctgaccagaagccggggacggtggactccacctcgttgccccacacgtcccagccgggcggggtctgccttgcgaacagctccacacggggcaggtcgcccatcagggccacaatcttgtcccgcgcctcgtccggctttttgctatgggcctcgatgggggaaataatgaactggtggacgttggccgcctgccgcttggggtgtccccgtgttgccagcaggcagacctccgcgttggcccttgtccaaaatcccaggccataaaaccagctatccgccttgcggttctttttcagccacacaaaggccgcgctcttataggtgaagccccaggcccggattagccgcagcgcctccgggagctgggggaacgtggcccacaaaaaaagcgcacagtccggggccgccagatcggccacgggcaacgcgcacagttcgtcgatccccattgtggggtagtgatgctccgccgccccctgcaagcccttttgggcgtagcgccagggcggatcggcgtagatgatggaatatttaccgatagtcaaactcctttcccgccctgggtgacggcctcccgcgcccgttccaggcgctcggtggccgggccgtaaaaggccggggcgttttcaaagcagatgaagcggcggcccgtgttcagcgccgccaccgccgtggtgccgctccccgcgcagatgtccgccaccacctggccctcgcgggtgtaggtgcggatcaggtactcgcacaagtccacgggcttctgcgtggggtggatggtattcgccaccgtggagaacgccagcacgttcccgggaaaccgccgcccgtccgactcgccgctggtacgctcaaacttcccatagttagggctggagccgctcctgtggtaaattttcttgtacggctccccctggtcgaactgcgggtagtaggccggggccttgcggtagaacaccagaatgttctccgactttttcagcggggcgcggcgggcgttgagaaagccggtgcatcggcttttgtaccacacccattcatagcggagcatggggaggttggacgcgcccagcaccttgtcataggggcactgcgcgaacaggagcaccgcgccctccggcttcaccgcccaccgcaccgcctcccacagctccgggagcggcaggggcacgtcccagtaattccgggtggtgccgtagggcggatcggtcaggagcatatccacggaatgacggggcagggagcgcagcccctcgatcccgtccatgagaaacaagccgtccggggccaggggccgcccgtccggggcaaagctctggccacactggccagaagtaaagcaatcctgcatggatcacctatcctttctttttaatgagcgccaaagacgcgctgggcgatcccgcccgtcttaaacagcatgaaacagagcaaaaccgtgtagccgatagtcccccacacggccccgatggggtcgccgcccgtggcgatgccctgaatgagcaccgcgtaaatcgccacgcacaccaggatcagcatcccctggaacgccacggcaaacagggatttcaggtagttctgccccgtcccgcccaactcccggttggagagggtcgccacggggatgggcgctaaactggtcaacaggtatatttcaatcatgcggccatacaccaacacgaaaataatggtgttcagggccagcattgtgacgttgatcagaatggattgcatgaacagccccagcaaagggccgatgtccattgtttccagtgtggcctccaggtcggccagcatatccggcgtgatgtccgtggagccttggatcagccccgccgcgctggcaatggcgctttgggacacgtcgaacacggccattacaatgttgaatgtattggagagaatgaggatggcgcaggcggtcttgaacatccacttgtagatattcgccacgtcaaactcgtgcatattgttcttttccaggatcatctggatcagctcataggtcgctacaaaggttaaaaccagcccggcaatcggtaggatcaccgtttcggaaagctggcggatcagggagaacaccccggcgtgccacgccgccggggtagttcccacctgtaccgcaatctccccgacttgggcgttgacgttatcaaacaggccgctcaggttccccatgatcccgtcaatcaaaagctctttgagccattccgtgatccagtcggtgagaatacccataggccccggcccttaaaacagggtggagagcagggggatcagggtggtgcccagtacgatgatgccgccgcccgccatgagctgttttatccccaattaggtgtaaaactctgctcgatggcgggcggcggcgtacaaaaaatctatatggtgtttttaagagaaccgtcccggcgggacaggtcaggcagtgacctgttccacctccgggatgggtttgagattaaaatgaatttcgatagaaatgtgtcttgttttatcttcgtcaatgcgctcatgcacgacgatttctttgattaagcggttgagggtggctgcgtccagctctgtgatgttggcgtattcctgaatggcttccacccattgttttgcgtcattggcaagctggacttcatcggacagccgcttcctgccctcggatactctgcttttaagctccgtctgctcggtctgtgtcttttccagcatggtgttgaaattctgctcactgatacgccctgcaatcatatcctcataaagccgcatgaccattttgtccagaacctcaatccgttcctcgtcccttgtaagggagcgttccattgcttcccgctgttcccgctgctcggcttcacaggtattggtcaggcggtcggcaaccgcttccccgtccatcagggcagctctggcacattcccggattttccgcagtacatggctgtaaagggtgtcataatcaatccggtgctgggtgcagtggttctttccaaaggcattgtaggtcttgcaggagtaaatctgctggggatattttgcgtttgtatagcgtatcgtcagcgacttcccacactcgccgcattttatcagtccggcaaacaggctgatttcattggtctgccccggacgctggcgggatttcagcttgttctgcacaatgtcaaagctcatgcggtcaatcagcggttcatgctgtccctccaccacaatccagtcctccggcttcttttccccaatcgtgccgattttgaagcggtagtcctttttctgggaagcaatcgccccggtgtagacgggattcatcaaaaggtctttgataacggagaagtcccacatataccgcccgttttccgggtctttcttttcccatttggtgcgggtattgcgaagcccccgttcccggttccaccatgtggggcaggggattttttcttcctccagccgtctgcggatatagttcggaccatgaccgttcagggcatatccgaaaatcagccgcacaatcggggcggtttcctcgtcaatgagcagatggtttttgtcctctgggtctttccgatacccgaacggggcaagacacccggtaaactgtcctttctgcgctttcagaagataagaggaatggactttcttggaaatatccttgctgtacatctcgttcaggatattcttgaacggggcaatatcgttgttatcacgcagggtgtcgataccatcattcatggcgatatagcggacaccgtttcttgggaaaaagtcctcaatcaaatgcccggtttgcagatagttacgccccagtcggctgaggtctttcgtgatgacaaggttgatttgcctgcgctcaatggctctcaacattctctgtaaatcaggacgctccatattaagacctgtgaagccatcgtcctgatagactgccacaacctcccatccctgcttttcgcagtatttttccagcatatcacgctggtttgcgatactggcactttcgccttgcaggtcatcgtcctttgacagtctgcaatagaccgctgcacgataacccccggcaagtgccgaaccgattgttctgtattccatttcgttcatcatagccatttacccacacaatccagacggtatctggctcttttgaacctcatcttcattatacttcaaatctttctttttagcaagatattcttttgaatttgtctttccatatttctgggaaatcaggctgacgaacacatcggttgcgtcaagctccccgtcaaacacagtagtcacatgaatctctgttttgttttttgccataggcagttatcctccatacatgaaaatagccagacagagggtgtcggcaacgaagtccggcaacgggcttcaaaagaccttgcaaacaatctcaatctggcgatgattactatttatacttttcttttatttttctgttgttttggttgttataagggagaaaagcccggaaataaggggttttccccggcaaccggctcggcaacgggatagcaacagggggtgcaacgggctgtcattttcagaatggaagctccatctgttctgtgacctccacaaagccatccattgctttttcagacgggttgcataagtccgttgccgggttttcacgctcccagcccttttgtctgccgtattcggaaaacattcttggattcgggaagtaccgccagcggtcaatgcattggttcataatctcgttgatttcccgtatttcccattgcttcggctcgtcaaaggcatggttcaaggcttccttgtagagctgcttggaacagaccatactccctgtgtacttatcaagatacgcctgtatcatcccggctttggtgtcctccggcataaaatcccgctggtgttctttgagataccgctgcatggcggggctgaaagccagcttgaacctgccgcttcggtaaatctccatcgcttccgcccacatctgctcaatataggctctggaagcagcttcgtcctccaaaatgtgaacctcggcttgctccgggtacaccatgacggggataaagcggcggttgccggaacggtcaaggggcaggaagtcaagagcattggaagtgccgccaaacacgcactggcgggggcggtctgccgggtgggtttcatagggtatcttgtagacctccttctgccggcttaaaaatgacttgatttcttcgatgctcttggcgtttgcagttgccatcatttccgacatttcgataatccagtgaccttgcagcttgcggtacacattgtcatcgtccagcttccgcaaatcatcggagaaccactcgtcccggactgccagcagacggaagaaggtggatttgccagccccctgaccgcctaccagacagagcatgatttcaaatttgcaccctggctgaaaggctcgtgagattgcacccagcaggaacagcttcaacgcttcataggtgtaatcgtctgcgtcagcccccagaaagtgccgcaggcagaaacggattcgctctgtcccgtcccacacaagggtattgagatagtcccggatgggatggtacttgttttcattcgccacaatcccgatggcgttatcaatctttttctcattggtaagcccataggtttcttccagataaagaagcagatacttcatgtccgtatcgttcagggcggtgctttccctgtgaaaaccgatgggctttatgatgtccttgcggtcggtcagaatgttgtatgcgatggccccggaaagcagcgggtcacgctggaatacggtcaggcagttccgtatgctctgacggacaccgcctttctcggtagtttccagccccgccttgatttcctcaatgctctggggcggctgcatggcgttcatggtgttttttagttcttgctgcgtctgcggctgcaagctctgccattcgctgttcaagctgtatcacatcctttccgtagtccgtaatcaaagctgctttttcctccgtttccccgaacagcagcacatccagcagatattccactcggtcttgcttctgtaaggcttccacaaaccggggatgaaaggcttcctccggggagtgcgggacataatcctttctccatgtcctaagcaggtggagataatcggcaaggatacgggagcagcggttctttgcttcctgaaactgttcctccggggatttctgccggggcttgggcttttttgcctttcccggcggtttccagtcctcataggaaagcccgaagtcatgtgccagttgtacggcggcttctttctttcccagcctatacagggcggcggcaaaatcaatcacatccccatccgcaccgcagccgaagcagtggtaacgccgatccagcttcatgcttggggtcttatcgttatggaacgggcagcaagccatcccgttccgacctacacggattccataatgctccgctgcctgtcttgttgtgacagactgcttcacagcttcaaatacattcaaatctatccctccttgaaaaaagaaaaaacacctgacattctctgattgaaaatggcaagtgcctgttaaagttccatatcctgttgtctgtgtttcgcctgtgccggggcggttctttgagcctttttctcgtctgccttatcctgcaagacttccttgatgggctgcttcttaggcggctctttactttcctctgtgccgggtgtggctttccgtacccagtagcggatgtcccgcagcttcttcaaatcctcctgtacctcggtcagcggtactttcagctctgcgatttcgctgagaagtgtttcctgctcctcttgcagctccttttgggtactatccttatcgtccgggtgtttggcaaggtaggcggtggctttctcataccgggcaacctccgggtgttcctgtttgaatttctcctttgttttcttgaaaaatatcttctggtatttctcatagacgggcttacattctttgcagtctgtccggctggcaagaatcccgtcaatcactttgctgcgggcttcctttggcttcatctgattgcggtaatctgcggctgatttcccggaagattccagaaatgcttctaagtcctccacagtggaaagccccttttgccggagataggacagggcttcgctgactgcctttaagtcctgtgaagtcccccggttctgtccagcccttgtccagtccttccgttcttcctttcgtatctccatatacttcatcagcagattgggaagaagtgtcgcttcctccgccgctttttgtgcaagcaactccttccgtttttctcccagctcggcaatccagcctttgaggttgtggataagctgccggatggacttcatcaggcggttggcggctctgatttcccggttcaggtttccgatattcgtctggataccacgcttttccatctgccggacagccgctccctcatggacagtggggactatatcaaacccctgtctggcataggaacgcaagtccacacgctccgggcggtcattggcttccagatagcggttctggatgacctcccattcatgccgccagatttcacaatatttctggtcgttccagtccaccgtatcctccttgtggcttttccacctgccggacggaagttttatccgttttccgctttcatcaaggtcataaaccttgcggctcttgggaagccatttcccatgttcgtccattgccctcatagtcagcaggacatgggcgtggggattgtgtcccggcggatgggggtcatggatggcaaagtcagcaatcatgcctttggaaacaaactgcttctggcaaaactccctgacaaggacagcatactggtcgggcggtatctctctggggatggtaagcacccaccgccttgcaagctgggagttccattgcttttccaccgcttcggcggcgttccataaggtattgcggtctgcatacgaccgtggggcgtttgccgggagcagaatttcattgtggacaataccacgcttttccgggtagtgcttcacttgctggtcgtattcacagaacagcttttcgccgctttggtaagcagcggcggcaaccgcagactgtcgctggctgcgctgaacaatcgtgatttcgttgtgtgggcagggcatttcgtgtccctcctttcggtaattggtggatggggtggcgttttaccacctcattttggcagaaaaaaagcaggagacctttttcagatttcctgctcggtgtgccgctgtgagggcggcggatatttagttgtaaaagttcgggacaagttgacccgatgggtagatggtacacttaaaaattatggttctcttgtcattagctcattagcataatgattaagagcttcacaaggttcatatttgcatttataaccaataccgtcaattataataaatggattgtatgctataatctccacttgagaaccatctgccaaagacagagtgaaaataactgcttgtccggcatattctgtatatgagttgtccttattgtaaataactacctcattgagatatgatactaattcctctgtttctactatctgaattgttgtatcaggtggcgataaccgaacacttgccgaagtaatatctgctgcctctaaatctttgaatggtctatgagcagaaaacaaaagaaagctaatacctataccgattaaacatatcagtgcaattaacaaaaactttttatgcttcatttgattctcctttacacactactatgaaatttctttttcatcatctcttggtggtcggacataacataacatttctttttcacaagcaccaaattttgagaaattggatttcgcttcttttagcgttattccatgattagagtcacttggttcgttatcagaagcaatgaacgggtcattctcccaaaaacaaacgggacagatatacccacaatcttcatttgccggaacattataggtaaaatatccgcagcaaggacattggtattttttcatataaacctcccgtttaagccttgacctcaaattcctgatttatttctgactttattatacttcatcgattatcgaaaagatagcatattttatgaaacttgtcggctgggaacagcttacagcgcaaggtgtccccagatggcaagtccacaaaagggtagctggcggcagccagcgcaggggaagcgtagcgtcccctgtatgatttggagcagaccttgactgcggaaaatcacagccctccggcgaggagccttcggagaacgcaatgcaccaacctttgggtggtgtataattgcgcccttagtaaactaaggggtttccggcttctcccgttccagcagtttcttcaatagttcctgcgtgtcctgcctgtgaaaaatgagtttcaacaacagcataacatcatcatctgtcaggcgttccggctcttgcagaaaactttccagcataccgccacgagtacagagccggtgcgttcgttcctttcgggtaagctgctttagctggtgctgcaatgccttttcatcattgagggctttccgcagtttcttttcactcttttccaactcccggttgagcttttccagctttgaggtatcaggcaagggcagcgtcctcctttctcggtatcagcacataaatcctgtttggttctccaacgccctgacgcacccgcatgataagtccggctgtttccagttcattcaaagaacgcttgaccgtcatagagctgcgggacaggactgcggcaatgtctgtgacagggaagcagacaaacaggattccgttctcgtcctcctgccctttggagagcatagcgtccaacatccggcagtacatgacctttgcggtgctgctgactggaaatcctgtcaatgctctgggaaatggcatacagggcggcagtggtgtgtctatcgtcataaattcaaaattcattcggtgtgttcctcctttttctttgctcgtttggataaataacgggggcagtcaatcacaaccgcccggaagctctgcctgcactcatgctggcatttccggcataattcgttgtaagtgacacgcccccggtcattgaggtaaaaagaaagctcctgcttcctctttttgctcattctcggcatattgcgtttcctcccgttttagtgtatggtttcggggcgattttcggcaaaattacagccatagagccgcttaaaatctcccgaagtatcagcgatagggtagactatccccctattaaattgtcgtgtttcggtatcatttcggtgtcagttcgccagttctccccggtgtcgttcctcccctgaatctcacagcggcgtatcgctcccgttggtacgctcgtttcggtcagggttcctccacatccctgccaaaagtcatggcgctacatcgctggggaagcatatcccacacaggctggtcattcgattggaataatccatcgatgaactacctgtatcatagaacatttttgtgccctgtgccgtatgtccacaaagtaggaattaaggataaaaagcggaaatttccacgattgcggaaagtgtgatataatccagttaagcgacagcaatgaaaccgccggaaaggagtgtgcgcccatgaaaggagcaacaagcatacaggaacgcctttgggaactccgcaaggacaaaggcttaaatctggaagaactatcaaagctgacgggtatttccaaatctgctctcggaagttatgaaaaagaggattttaaggaaatcaatcatggcaaccttatcacgctggcagacttctatggggtttccgttgattatctgctgtgccggacagagaaccgagagcagatcaacacgccactaacagagctgcatttgaatgatgagatggtggcacttttgaaaagcggtcggattaacaaccgcctgctctgtgagcttgccacacataaagattttatcaagtttcttgcggacattgagatttatgtggatgggattgccaccatgcagattcagaacctcaacgcccttgtcgataccgtccggcatgaaatcattgaacggtatcgccccggcgaagatgacccccatttgaaagtgttgcaagccgcccatatcagcgatgatgaatatttcagccacatggttctggatgacctcaacctgattatccgggatattcgggaagctcacaaaaaggacagcgagagtgcaccccagaccaccgttgccgatgaactgaaagaaaatctggaagcggttgaaaatttcaagggcagccgtgatgaaaagctggttgtcctttactgtaagcagcttggtatcaactataaaaatctgtcagatgaagaatttcgctggctgattcggattctcaaaaaatcaaagaaaatgggaacgcctatcagccagaggaaaaaacgataaagaaaaaccgctgttgcatggtttgttggcttccatgtagcagcggtttttgctgggattattcagttgaatttttagcacgacaaactggaatttgtcaaagaggattattccaatattccacagtatttctatttacatcataaaaagtaatattacccgcatttataggcaagacaatcgcaaaaggtttattgcggtcaatatcaaccacttgaattgtgttgccatcatctatttcaagttgttgcacctgctgttgattcatagaaataaatgctcgttcattatatccctctacagtaaactccacaattcctctttgaatccccgaaagagttccacctccacggaaaaaatatccgaaggaaagtcctggacgattgacatagacggaaaaagaatggtcactcaaatcctgagggtaagaaatatatgcagccatcgtgctggaaacgcttccatcgaccgtccaatcatccttaatcttctgcgacgaacgaatatctgcctccagcttagatgaagtcacgccgatctcattgttcgtataaagaaaacaaacaaataaaatacaagcaagaacaacccctatcacaattttaagaaatatttttttcacgctatcaaaactccttgtcaactttcgatttgtcataatcattctaccataccgttatgaataaatcatctcttgcaaaataatttcttctgcccggttgtgaatgttattgcaacgctgcacccattccatttgatgggtacgcttcaattcctcggtcacaccatcggcagccttcatctgctccatgatggtgtctaaccgttcctgtgcctgttcgttcaggtctgcaagatatgtccataactccccggtcagtgtcaatgtgttcaatctggctggatgggcttctcttaaatattcccggtgcatccgtccgtactttccgatagggcggtgttcctccggcagcttcaaatctgggatatagtaatctccgacaaggatataatcaattccgttttccgttattcttggtttcaattcgctcatgttccttacctcctgtggaagcaggctcgtctggtactaactcaatcacatcggtaatctcacaattcagcgtttcgcagatacgggctaatgtatccatgctgatgtgctttccctctttgctcatgttggcaatcatattcgttgtcataccggcggcaagccttaaatcttcttttctcatatcacgctctaacagtgtatgccagagtggtttatagctgatgtgcatattgttttcctgcctttctatccataccaccggggcggctgccccggcaggaacttttctcttattataacaccaatcttgtgtaatcacaatttattcttgtatcctgccgctgataccgtctggattgtgcttttcctttctttttgttccctttaattagccataaactgcttgatgccctggcttttggccgccgcattgtccgagccgtagccctccagcagattgaccacgccccacacggccagaccggcccccagggcgatgacgagcgtttgcagggtggtaacggcagtagagaaaaactgcatagtgcctccatttctccggggacaagccccggccatgaaaaaagccgccttttcaggcggctgcgtccacctctggccacgatggccagaagctatacaaaggcgtccgggtcgtcgagatcgtcatagttgaggatgtcctcgtcctcttccatgtgcccctcgtccggcacgtccacctcgtacacggtgtattcctcgttggggtttaccttgtccatgcgccgggagatcaggcggcccaggtcaaaggcgttgcgcttgtccgcctcggcggtgtacttgtagttggggtgttttttcaggtcgtacttgggggagtagaacggcggcaggccccggagctgtaaaatacagcggtcgcccggcatggtcgccagctcggcgggggtcatcaactcccggcccagccgttgggtgttctggctgaagctctcggactgcccacgggatcgcccctcggtctgcatggagatggtggccttgcccagccagttctcagatatttccttgatcgtggagctttcccgcccgcccaggaagatcacgctgtccatgttgccgagtatcgtttccgcgtgtttgtcgtagattgccttacactgcgccatctgctggtaaaacaggcacaggctcaccgatcttgagcggataacggccaccaatttttccagccctgggacttgtcccgtgttggccgcctcgtcccataacacgcgcacatgatggggcaggctgcccccgtgtacggtgtccgcccgttcacacagcagattgaacatctgcgaaaaggccagggccaccaaaaaattataggtgctgtccgtgtcgctgatcacaaaaaaggtggccgtccgccggtcgcctatgcggtcaagctccatttcgtcatagctcatgatctcccggagctgggggatgtcaaagggggccagcctcgcgccgcatgaaataagtatgctgcgggccgtcttgccgctggctaatttgtacttgcggtactgcttcacggcaaagcaatccggcttgcgcttttccagcccggcaaacatatagtccaccgcgttcataaaatcgtcgtcatcttctttgacttccatgccgctgatcaagtccaccagggtattcatatttctgtcctgctccggcccctcgaaaatgatataggcgatcagggcgcaatacaaaagcgtttccgatttcgtccagaacggatcgccctccttgccctcgcccttggtattggaaattaaggtattgacaaacttcaagatgtccgcctcgtttttgatataggccagggggttatagtgcaggcttttggaaaagtcgatggtgttgaacaccttgatcttgtagccttttttcttttgcagaaaccagcccacctggggcaagataccccctttgctgtccaccaccacataggaagaatgggcctggagcagttggggggtgagccaaaatcttgttttgccggagcctgacgagccgatgatacagcagttgagattgcgggcgttccccggtattttgggccgggtgttcatggtgagatattccgtcccggtcaagatcacgttgttttcaaacttgggatcggaaaacggcgctatgtctttagggccgccccatcgggcgctgccgtattccgcgtcgggccggtactttttcgcctttttggtcttgaagcagatgagcaggcggaaaccagccgcccccaggatgcccaccagccagtcaaaggggacgaggcccggtgcgaagtccgcaaaggccgggccgatggtctggatcgtccccaggagcttttcaccaaagccagcgcccgccgccagacggtaggccgtccccactttcaggcaggcccacagaatgaacaggtacggcacgttgggtaaaatgtacttgcggattttatctgtcctcatgtgttgcctcccgttcccgctggcgctggggccgttgcttcatcagctcctgggcacgtttgagctgttcccggatggggacgcgccgatccctggagcgtttcagcatacgccgggagtattcctggaaacagcccgtgatggcgtcggcctgccttgccttgaacaacaacaggtacttgcccttttccacgggccggatggcgtagtccacaccccagcgccgggccacacggtcaaacaggcgggtatcgccaggcagctccatgccgctggtgtcgcccccgtggcgcatgagctttctcgcgctctgcttgccctggggcgcttgcccggcccgctgggccttgcggattttccgggccgccgcccccagcacatacgccagcccccgcgccgtcagcttaccggcccgcacggtgatggcgatactgctgcgggatacctcctcgtcaatcattcaaaccgcctcctttcgggccgggcctctggccacgatggccagaagcgccatcaatgccgcccgcgcctccggccctggcccttgacggtcaggatgccctccagggtggtggccgtgatccccaaccgctgggccacggcgatgtcgtttttcatttcctcggtaacggggccgccgcacaccaccagcacacgggagcgccggagcagatcgcgggccatgtcggtgccgtccttatgctcctggggcaccgcgtcatggaggaacaagggcagatacagcgtggggcagatgggcgagaagcccgcctcgtacacggagcggcagtagtccgccgcctgctccgtcacctcacagggatcgccgcgccatgcggcggtaatgtatgcaaggggtcgtttcatatcgaaaacctccatttctaatttgcatttcaggggtacgggtcagccctatccccccgccctttcccattcatgggaaagggggcggctctggaggatatacccccgtcgcgccgcaggggatagcacagccggggcaggccgtcaagggcaagccgccgcaagcggcggggcgttccgcccccttgacagccagctcccgcctgcgctgcgaaataggcggcgacgggggatataaaccgccagaccctcggcgtcgcaaagtccgttgcgctccgtttccgcctccggcgaaaactacgcccactcccttgctccgcctctccccacaaagtctgcgactttgcggggcaccccatttgagggacgcggggacatgaaaaagcctctggtcaggatggccagaggttactccttttccatatccatctttttgtcccccttgcccagctccgggggctgtttctctttccactcgtccagcagggccacgatctgatccttcatttgccggggcgtggcctccttgccaaagtatttctccagttcagcaccagtaataatcacgtcacgatcctcctttttcttttcttcactcaaaatagcgtcgatcacatcgggtttcagttggttttccttatccagttcccggagccgcttggcctgcccctgggacggggaggactgctggccctcaatggaaacggcaatatatttctggtgtttggcccggatgcgggaaatctccacggcgggggtaaaggacagcttgccctcgtccatcgtctttttcagatcgggaacaagatcattcaaccagagataccgctggacggttttcacgctcatgccgttgcgctggcccacgctttccagagagagctttccggcggcctcgtcatccccacgcgccccctggtgcttgatcgcctcatattgctgttgcagggccgccgccttttcgctgggcaggagcttctcgcggtgccggaggttgtcatccgtcatagcgagaacggcctcgtcgtcggtcatgctgcggacgatacagggcatattgataaatccggccagctcgctggcccgctgtcggcggtggcccgcgacgatctcatatccaccgccctcacgggggcgcaccagggcgggctggttcacgcccgcagctttcacggactccacaaggccctgcatttccgcatcgtcccgtaccccaaacgggtgatccttgaacgggtacaggtcggaaagattgagatagacgatctcttccttttcaccacgggacgcatcgcggggggcgggcggttcgggcacaggggcctccgtcttggccggggcgggcttctccggggccttttttacgccgccagccttggccggagcagacggcgcacccttgccgggggcggcccgcttgcccttgccgggggtgtcctggcctttttccgttttgggtgggcggctccgcttgggcttctgcttacgggcctcaagctcggcgctggatatttcccactcctgccggtcatcgtcctccagggccttgccctttggggccgggccagcagggggattagtcacctccggcgcgggtgggtctttcttctccgtaacggcggccccgtcaccgccgccagcgccctcccggacttccgaaaggttgatgaccttatccggggggccgtccggcgttttggccgggggatgctcctccggggcgggggtcggctttttatcgtctggcataaatacctccttactttcgggcataacaaaagggccttaacctttcggcccggcccatccttgacaaatacgccgcacttgtcccgctggcggcgcgttgtactccatatttaccatctgttttccccggccttgcgccgggggcggctttgcgctatgatataggggacggcttgcggcggcctatgccgtgtagtcctgcattacgtcgtcatagtccagcaggaatgaaaagaggaagtaactccgggccgcagggtggctggccagaagttccaccgtttcggggaatatgaggcccaacacgccgtacagcacccgcagggcctccagcatatcctcctcgcgcccggacgagtacaggccgttcaacaggccatacacgcgctccgccgtgtccttatcctcgcccgtgaccgtccagagcatttccacaaagggcggcacatacgccccggacaaaaggttgattttgtcttggcacacgtcccccgatgggcgcactatgccctgtgcgattagcttttctgtcattttacctcgctttccgtggtgcccgattggtgcccaaccgtacaaaaacaccccttgcggagatatgacacaatataggctattcttgaaaaatgccctattttcaagggtttgcggcctttccttatgccgccctatgaccccttatgccgggtttttccggctttaagcaataaaaaatcataggaggccttttattatggcaagagaaaagaaaccggtacaccaggtacaaatgacagacttccaaattcaattcatatcgtttgaatctgtaaaatgtatagtatacatcctcgctcactgatattaattgtccatgcattcttattacgtatgtctccttatcattcattatatatcctccatttcaaaatttttagtttcatattttgaaatggaagggcggcgccctgggtaaataaaatcccgcagcgcatgataggtaaacaatgtttggtttagcatagttagcaacatagctggagggagagctctttggttcaggacagtaaataaatttttctttatgtatactgcaccaatcccaacacattgcgtgtgtcataggaaattggtgatatctttgcagtaagctctgacattgagcacattgcctaatatcatcaacccctctatcctgcaacgcaggatggcacacaaccatttttataccccattaaaaagaagctgccatgccagtctaaaacaatagtctaacgataggttccggtttgaacatccagcctgataatttcagcatttacgtttcatcactcacctttcctgctgattcttctttagttagggataaaataaaaaacgactctttcgatgtttctttcgtaagagtcgtcgttgaggtttgaatggtatagttatattttaattttttacttgttttttgaagtttgttgttattatcagaaaattataattacatttatagaaataagcgcaataattcaacaaatacacacgagttgcgtcattttatgtacgatataaatggatatatctaaatatctagttgaattatgaaaaagcgaaaaagaaggtgggttttgtcatagatattacagattcttttctaatttgcatattattactatctttttatgccattattgatttgtttaccgatgccatttccgtaaacgcccaatagcacgtacctttttatcatcatcattctttgagataataggcccaacatcaaaattcaaaatagtttagtattcagacattaatcgcagatgcatatgccaggacggattccttcaattttgtccccgccttcaagatggcttctgtttgactgttcaatataacgggataagatgccattgtctcttctaatgtggtttcaatttctgccagatgtgatttgagagaatcataatgattcattagcatttcgagaaaatcctgctgaattatggaaagagtaccgttcacagccacaagaatctcattgatgtgattgcagttttggttttcagacaggaatcaagagattccctatcaatacagacattgataaagtaaagacccaaatgcgtatatcttgatatcataaaaatgtcaattgaattcttacagaatttaacttataataaatttgtatgttcatcggagagggttagctccggacagaaccatataggtaatctgagttgttgaaaggagcatacaatgaactccgaacactaccgtaattttattgccattgttgaggcggggacattatccgctgcctcgaggaaacttcatattgcgcagccagctttatccaaccaggtcaagtctatggaagcactgttcggtgccccacttttcaagagaaacgtccgttccatggaacccacagaagcgggaatgattttatatgataaggcaaaacacattatcctcttggaggatgccgctgcaaaggaaataaatgcatgttacaaaggttttaccggctccctgtccttaggcattactcaagcatatcccgacccaatgatagagcggcttctccatcaatttcataaggaaaaccacttcatcaaatttgatatatttgagctgaccagtgcggaaatcatggacttactcaaaaacggcatcatagaaatcggcatcatccgcacattccatcagattcctgtatacctggacccgctgtatacaataccggaacggcttatggttgtggggagaaaagacacactctggtttcccttaaaggaggagattgatatattcgccttaaaggacattcctctctcaatttcccgcggctttcaaaacaccattacggaagcctgtctgagggccaattttacacctgaaatcttaagcgtatccacctcccggaacaatgcgctgacctgggcaaggaacggcgatgcggtggccatcataactgctgacaatgcacctgtctacgaaaatgacactgtcttctgccgtcccatatccggcgatatgctgagccgcaggacctttgcagcgctcagggggcgttccctgtccaatgttgctgccaaatttatggattttgtcagggaacattcaaacgaatataagcaggcatgacaatatccgggaacagcaaactgtctcccggatatagcttttccttattttattcaaccagtgcagtcggatttttacataccatctgttctacatcgctctgtgaatccccgccttctttaaccatctttgtaattaaatccagcataccttcatcagaagaagggctgttcttttgtcccatatcgctggacaggactacgtggctacatccaatcttcctaatctgttcaaaacccgtttcataagaacatttatgatagggaagcagatgtcactggcttcatagtcacggtttcctcctgtcccataaggcttctcaccgccctgcgtttccaggaaatgcttcccgttataggattctatcatttagcagttgcctatcctgggaatttttcatggccgcctcccatcacctggggctactcataaaaatcatctgcagaggtaacgaatcccaatattatttttctgggtcctgctgcctacgccaccataagtatcacctgtactgccagaaccagtgctatcagcgcaaacggataggtggctgcataggcggccgccacatcgtccgttcctgcgaccttggtcagtatagccagtgacggggtgcaggtcatgctggccgagatggagccaagaccgttcagaagcgggagcctgagtatcttaagtccaatgacaaatccggctgccagagggacaagcagcagtataagaccaatgaacagaagcctgaaaccataggtctgaagtaccagtaccaggccttttcctccctctgcgcctgcgcctgtaaagaacagaagcaggccaatctccttcattacccttgttacccctggctccatctttaaacttacaggccctatatgacccatatgtcccaggagtagtcccaccaccaacggtccgcctgttgttcccagggaaaattcgccgccacccggcaaaggaatcacaaaggagcccagcaagattcctccaatcactgccgcggaaaatggaaacagtcccattgtatcaatttgcctgtaattcctgccccattgccgccctttttccttctccttcacggcaatcagctcccgttccttttccatatccgcattaaggattctggggaccaactgcataaagaacaccttccccactactccgatggggtagactatcccataaccggcagccaccatggttactgcctgggcactgtccgaaacagcctccttggccgctgcaaatcccggtgaggtggtaaatgcccctgtcatcattcccactgccaatgccttatctatccctgtcagttttaccagcagaatacatgtaaaggatcccgtcactgcaatggaaagacagagaatgatataggcagccccgtttgccttcaccctctctgcaaacgccggaccagccgtcataccgactgatgcaataaagaaaatcaacccaagtgtctgtatgtatgcgggtatggatacaccgaaatgaccgaaaaaaagaccggagataaaaagagccgccgttcccagctcaaccccctttatgcggatgctgcccagaaaataccccgtaaccgcaatacagaaaatggacaggataacagaagctgtctctttcaatacaaacatagaattatcctcgtttcatccaacttcagcatgacaggcatctctcataaatgccccgttccttcagcaattcaataagtgtctctccaatcaggtccgacatcctggcagtgggaataccgcactcattgagtaccctgattttttcagccgcagtaccttttccgcctgaaatcactgccccggcatggcccatgcgctttcccggaggcgctgtttgtcctccaataaatgctaccaccggtttattcatatgctctttaatccacatggcggcctcctgctcgctgtttccgccgatttccccaatcatcaccactgcttctgtacctccgtcctcatgaaacgcctgaatcacatccaggaaagaggtccccttaatggggtcccctccaattcccacacaggtgctctgtcccaggcctgcctccgacaactgcttgatggtctcatatgtcagggagccggagcgggataccactcctatctttccgggtttaaccacatatccgggcgtgattcccattttgcattcgccaggcgtcacaaggccagggcagtttggcccaatcagacgggtcttcttacccttcatataattcttcacttttatcatatcctgaaccggaatgttttccgtaatgcagacacaaatatccagtcctgcattcaccgcctccatgatggaatcagcggcaaatgcaggcggcacaaagataacggacgcattggcccctgtggcctccactgcctgggcaaccgtgtcaaacacaggaattccgtccaaattctgtcccagtttcccgggtgtcactccggctacaatgttggtgccgaattcgcgcatgagctgggtatgcttttttccatgaaatcctgttataccctgcactataacttttgtatctttcccaatataaatgctcatatcagctgccttcctttctattaaccaatttcataataagctctgctccttctgtcagagatgaggctgtgtaaagtcccagaccggattcagctatcatctggttggcaatgacgcagttggttccttccaggcgaatgacaatgggcacctctggccggtttttcctgatagaggcaatcacaccttctgccacccggtctgtctgggtaattcctccgaatatattgaccagaactccctttaccttctcctccgacagtatgatgtcaaaggccttttcgcattcttccgggctggaactgcctccgcagtccatgaaattggccggttctccgccaaaatatttgatggcatccatggtagccatggcaagccctgccccgataaccagacagccgatggttccatccagagaaacatagttcatgttcaggtccacggccctagcctccagttccacttcctcctccctgtcccgaagctctgccagttccgggtggcggaacataccactggaatcaaatccaacctttgcatcaatcaccatgagttcccctgcacctgtcagggccaatggatttatctccaccatagaacagtccttttcagtaaatacgcagtataatgcgcctgccattttcacgaagctcttttttaattcagcagggatatggatttgttccgccagggtgtataactgccatgtacgcaagccaattcccggttccacataagtcctgatgattttttctggatgattggcagctacatcctcaatgtccataccgccctcttctgatgccaccagtacaatttgtccctctgccgaatcgattatgatactgaaataatactcctttacaatatccgttcccttttcaatccaaagcctgcgcaccagcttgcctgccggaccggtctggcgggaaacaagggtcttgccaatcagttctgcggcggccgccctcgcatcctccggtgtctttaccagcttgattccgcctgcctttcccctgcctcctgcatgtacctgggatttgactgcaaccagaccgccaagttctagtgctgcttcataggcttccccaggagtccatgcaagccttccctcttgaaccggaattccatacgatttaaataatgtttttgcctgatattcatgtatattcatatgtcttctctcccccctatgcaagcagactctgggcagaaacgattcccgcctggaatgccttacggttcatgtcatgaagctttggcgcgaaccggttcagaatagcctgaagaaccgcatcactgcctgcgcacctgcccagcacagagattgcgcctagggccaccacattggcggctatgggctttcctgttacttccattgctagttttgtcagcggaatcctatacacgtgttcaatatcctgcggaacttccttcaccaggtccgaatctaccagcagtaccccgtctttatccatatccaaatggtatttatcacaggccatctgggtcatagccagaacaaaatccggctttctgacaatcggataattgatggaatcattatcaacaatcagttctgaacggcatgcgccgcctctggattcaggcccgtaggattttgccagaagaatttcatttccctcaattacacctgcggcctgggccatcacgtcgcccatcagcatcatcccctgaccgccggaaccgccaaatcttatttcataatgtctgcttcccatactcagcactcctttgctctcctgattacttcatcatagatttccgaatactccctgcggtccccgcggttcacaaactccccaatgaccagcttatcctccaattcctcagaactcatttttgccgccctctggagcggcacggctgtttccttccaatgcataaccatatccgcagcctctcccttcttattcagccttccgtatagggtcggacagtcacatgcagcctccaccacggaaaatcccttatgattaatggcctttgcaatctggtccgtaagcatcattgcgtgatatgtagtggaccttgccacataggttgcgcctgacgcctttgccaggtcgcaaatatcaaaattggggtcgatatttccataggcgcttgtctttgtttttgctccgtagggggtggtgggtgagaactgtccgccggtcatgccatagttggaattattgaacactaccacggtcatgtcaatgttccttctcgccccatggatgaaatggttgcctccaattgaagtgcaatcgccgtctcctgtcaccacgattacatgcaggtccggattggccatctttactccagtggcatatgcaatggcccttccgtggtttgtatggattccgcacagattcatatatccattggcacggcagcaacatccaatccccgcaacaacaaccaccttatccgggtccagtccggtcttatctatggcccggataatggactggagtacgattccgttaccgcatcccggacaccacatggtctttaatttatcctgacgcagcagtctgtcaaatacatgttcagtcatatcactttacctccttaatcacagccagtactgtttccgcttccatgaccatgccattattctgggtgacagagaccaccggcgtatctgatgtgaactgtcttacaatatgaaccagctgcccttcgttcatctcacatgttatcacggttttggcccggtctgccagttccttaagccgttcctccgggaagggccatagggtgatgggcctgaaaagcccggccttaattcccatgtccctggccgcgtcaaccgcacttctcgccaccctggccacaataccaacactgacaatgatgatgtctgcatcctctgtcctgtattcctcgtaagactcaatatccttgatattacgtataatcttatggtgcagcctttttacctcactgcttatctggtccgggttgctggtggatgggaaaccggtctcatcatgaataatcccactgacataccagtggtatccgtctccaaatgccgccatgggagggatttctgtcccatcatcctcataaggtctataatcttccttggggcatgatggctgtctgcggttttcaattgtcagctccgctgcatccggtatccgtatcttctcactcatatgggccagcatggcatctgacaaaacaaaaacgggcgtacggtacttttcggccatgttaaatgcccttatagtttcgtaatacgtctcctccacagagcatggagccactgcaatcaccggatggtccccatgggttccccatctggcctgcatcaaatcaccctgggccggaaccgtggcaaccccctgacagggtccctgccgcatcacatccaccagcacgcatggtacctctgccagcatggcataaccgatattctcctgcatcagcgaaaatcccggaccactggtggctgtcattgccttggcacctgcaaaggatgccccaatgactgctgcaacggatgccagctcatcctccatctgcatatactttcctccctgctttggcagcagttcagaagcatattctgctatctctgtagccggtgtgatgggatagcctgcaaaaaaattcattcccgctgccagggcacccagagtgcacgcctcattgcctgtcaaaaccctgaattcatctttcatcatcattacctcccatgcgaattgcaaaatcaggacatctgtattcacactgcttacatcccgtacagctctcctctgactccatcacaggctttccgtcttcatcctttgacagtgcatggaccggacatagagcaacgcagattccacaggatttacagaaacttctgttcaggttaaagtctgtcttctttcccattatctcgaactccttttcgtttattttgtatctgagcccactataacacaattgtatctataacaaaaatatcagtttttgaatgtaactatagtgttttgatatatatactactatgctataataaaatcattttgttcaagatttggccaagaaacatccacatcaagtcgttattgacaacgttgacaggatgtttagctgtgatgacccgtcctttagaggaaccatgtacgtctgccttcagtgcggtaacatgaagttttccctctccgctgtaaaagattcttatggccatgaccccttatactgctcgtagaagtttactatgaccatcacagagtttcttgcttgcctgtatcatatttaaagatgagttctatatcgtccttttttaatcactgtctgtgttctagtccctgtttctgcggggctgttagtttacataattttgttttagtaaggacttttctataatacaaaaggaaagaaataccgcaaagcagcctttctttcctttcttaaatctaatccttactaaaaacgtaccaatcccagtttatccgccccaaaatacataatcggatatagtattaatataacaacttttaccaacgtaccggtcttaagcatctgcttattttcaaccagtccagaacctgcggccaatgcattgggtggcgttccctgtggaagcatataggcgaatccacaagcgaaaataatatttaccatggacagcatgggtgcataaccggcacttttagcaatggatgcagcaattggaataaatacagctgcaacaacaatattagaccctaactctgtcaccaaagatgcaatgacagctaaaacaataattaaaacaaactccggcaatgcactgaagcctgccatctgtgctgcaatccaatcagtcagtcctgaatccgcaaaagcacttcccagtaccagcgaaccacctatcaggaacacagcatcccaggatgtatgtgatactgcgtatttaaaatccaaagtcggttcatttgtcttccaatttaccggccaaagaaataagattgctactgcaaatccacctatcatgtggtcggatataaatggcagaaatggactccagaaagtttttgttatccagcttaggattgcaaatgctagtacaatcaatacgtgcctttctccagttgacattgtacccaacttatgcaattcttctgtaatgattttacggtctatactaatgtttacctttccaagtcccatagaacggtaaataatataagtcgatactaaaatcatcatcatacagatgggaactgcaataatcatccagctagggaaatcaattactacccctgtcatctcctctataatgccaattcctacaatattagcattatttccaataggtgtggccgtacctccgttggtagcggagaaagcaactgttaacatcagggctgcccccataagcttgccataatttttatcatattcaccaattgatattgtcaatgcagctacaataggaatcatcatggctgtggatgctgtattggacatccacattgaaataattcctgttgcaaatgcaaatgacatcatgattgatagtggcttggttcccaatacagaaaggatggtaaatgcaatcctgcgatgaaggttccatttctcaatggctgagcccaaccaaaaaacagaagtagtcaataacactgctgtatgaacatatcctgatgtggcattgattcccgcatcatttaatcccaatgcaggaaaaagaagaacggggagcaacgctgtctgccctaatgtcactggctgtgtagaccaccatataatcatccataccatgctggccagaacctttttaccaacctctgttaattctccctgcactggtactaaaaaaagaataaatgcgaataatgccggacctaatatcagtccgattttttgttgttttgtcatttttaacccctttttgcttaatatattaatctatggaatatctctccttggactgtatataccttacggaagattttccatgcatatatgttattaaatggaaggttacaaccatacaccaccctatagaacttgcaatagctactgccgtaagagaatacctttccataagaatataggataagaccaccctggctgtaatatgtaatatggttcctgtcagagctatgttaatgcatcctattccgcgaaaataacccacaaaactgcttgccgtaaagcacaacacataaaatatggatatacatcgcaagtatccaatacctatatgcatttcattttctgtcacgctatagttaatcagtttaataaattgtgctgcaccgacatacatggcaatcgatgaaatcaagccaaatagaatcataagaatcagcccccatttcaatccgccttttactcttaatgtattctgagcaccatggttttgagccgtcaaagtggatatggcctgtcctccgctatttgaaaatgaattgataaaaccctcaaccctggtcgttgatgtgtaagcacttataccatatattcctaatgtattcacggctccttggattaagagctttccaatatacaggctggcttgatggaccagggacaccattccataatgaatcgttatcttaactgaactttttttaaattgaaaatcggattttccaaacaatagcagtggatatttagcacgtatataagctattgatagaacagcgctcaataactgggctatacatgtagcaattgcagcccccttgattccaatacccagttttcccacaaacagaatgtcaagcatcccattcacggtaatggatattgtaagaaatatcagcgatgatttggtgtcgccaatagagcgcagaagggaggcacatatattatacaaatagctgatgaccataccacctatgataaatgcaagatactcttttgcatatagaagcaatgcatctggtgtccgtataattcttaaaataggattcatcagcaataaagacaaaacgctgaacatcaccacggcaacacttccaggaaccaacgccaggaagctctcctccctgaatcttttataatctttcattccataatattgtgaaaaaagaatggatacgccaaggctgaatccaaccaaagcaaataggaataggttcattacagtacttgccacccctacggccgcaaaagcttccattccaatatactttcctatgatgacagcatctatcgtattataaaattgttgaagtatatcccctaccaaaagaggagcagccaatttcactatctgaaatggaataactccttgcagtatagcgtcttgttttttcataattaactcctgcacgttttaccatccaccaatatcatccatttgggggctgcataacaatggctgccacaccaaaatgcaacagccaccattcacgaatttcggaagattatatccggcaatatcttactataaatgctacttttcttctaccggtgtctgtaacgtatgatatccggtttctttcctcgcatcctttagtttcattcccgattttaccttacttacaatcatctgctccacttgttcaatcccttgtgcaaccttcaacacttcctctgcttttgaaaagggtactgcaactactcctgtgttatccccgactataaggtctcccggatttacctgaacacctgctatgcttaccgtatcatttacccggtccacataaacccggtctttaccggtcaccatataggttccttttgtataaataggatatctcaattccctgattacattaatatcccggcatacaccgtcaatcacggttcctgcaattcccctctgagcggcatatattgacataatatcgccccacacagtgcaatcctgacgtccattattatcaatgacagccacttcaccaggaaggatatcatcaatgaaatcccccacggttcctctaatctgtccacaaggtacataatgaacggtaaacgcctggccacatacatatgtatccggcacaactgcctttatgttcaacaaacctccatacagcttcaatttatccattgcatcggaaatactgggaacatccagtttcttatatgcctcaattatttccttaggtaatgttaattcttctttcatcttataccacctctgccctatccaatcttggcttcgacaagtttatcaaaaccatatatttccatagtgctctttcctgcatagagcatctcctttacttttatttccttttcatatatggcatttgctttagaaaaaacctcatcttccttttcccttggtaccactacaatgccgtcgcagtcaccaacaataatatctcccggtctgaccaggacgcctccgcacacaaccggaacattaatattcgccaaactctcttttacagtacctcctggattataagctctgacaaacacaggaaatcccagttctctgatatcctcggagtcacggcagcttccatcaatcacaactccagccaatcctcttattttgcatgcagtggccataatatcaccaaaatgacctcctccagtatatccatgacagttgaataccacaacgtcacccggattagcagcatagattccctgatgcaatgccaggttatcaccgggatagcactccacggtaactgctcttccaatcatatggcatttggagtctatgggtttgattgccgggtccatattccccttttttccatttgcatctgcaacatttcctgttggaagtttggatagctccaacactaactcttgtgttaaatccattacagaacacccctcctatttcaacattttctcataatgatattttgtatcaacttccagtgaggtcatgcctgcacgcaaatccgcaatcatggcttcctctttttcaaagagcatttctgccttatcaaggacagcatctattttttcccatggaattaccacaacgccactccggtcagccaggacagcatctcccggacgaacctggacaccaccaaactgaatcattacattggtggcctcctccatgactcttcctcttgcagtagccacaacagcccccctggaataaacaggaaaatgaatctctacaaaatcatccacatctcgtactgcgccatctacaactacacccgatatacccttcagctgagcgccgtttgcaaggattccaccccagcaggatgtgtccagacgccccccattatctactacaacaatatcaccttcttctgctgcctcgatggctttaatgcccaagtgcgttttccctgtggttaggcctgctgccgtcatcttcagagtgacagcgcgcccagttattttttctgccccttcccaaataggtcggataccatatgtagagccctttagacccagcgcatccagcgcatcagatacattggtggtagataatttcaataaacgattcttatatttctcattaaattcgctcatcattgattctcctattccctggtaattctcactaagccattagtagcatccacttccacataatcaccattctgaatctggttaatatcaacctggtccaccatgggaagttctgccacaatagcgccaataactgccacctgttctgcctcaatattaattatagcagccggcccgacaccattctttaccacatcataaagcatataggacccaccggtagaccccttccccttggggtataccagaatcttacctttgagacactctccttcaatttcatgtttacgttcaataatcacacctgttttggggttaacagtccccatgaaggatattccctcttttgttacaattgccgttccagcagcgtagccttctacaatacatctggctttcaattccttaaccattattttccctcccatttcccttccagtgcaacctggatacattcttctttattcaacaatactggctgcaggttccaaagaccaggagcatagtgcgccatcttgccggagtttgttgcaacagttttatatccgcggtccaatgtataacacaatacaggacatgtatcacagacaacctcggctcctgcctcttcaattatcttggtataccccattttatctcccagttccttaaccatgcgtgacgtacatacccatagggcactcttgagttttttaccctcaactagtttagccactgcctccatttcgttgatgcttacatgcgggcagccaattacaacaaaatcaatcggacctgtctgggcaaatttattgcaaaccatatcgtattctttctgaccaaatacaataggggtaagctctttatccacaacattttcttttgttggtgcttccggagttataccaatgatgtggtaaagggcgactgctcccgaagatgcaagtgctgctcccatagcctttaagttctccagggtaggcctttccttaataccttcaaatacaggtactcctggccccacaatattccctgcaaaatacccaagtgttgcaaagtctttgtctgttttcagctccatctcaaccttaaacagatgtgttccttttctgttttcatccaaatgataaccataagctggaacacgccctgtaatagctgcagccaaagcagttggcccgccttcccggtttgttctagcccctataacagagttgacaaaagcaatggcagatgactccccccatgctacatgctctcccatcataggaatatttccgttcaggtacggggtacaggaattagtgggaattgcccccatcttctcatatgcctgacttaactcaatctgcttttcagcaaactccttaggaaatcccatcctctcccaattctgataatctattccaattgtatttaatgtcattgggactcgaaatttcacctcctcgctagcttcctttacataattcaggccagcgtcccccgttacacgatatgacacgcctggagagtgtacatttctgacttcaatcatatggtctgcgccatagattttgccgagggtcaccaatactttcatactcttctgtacggttttgccatactcaccatcgagcatcttctgctcttcctctgttaatctcattttcccactccttttctgatttttaattcttgaaataaacttgtttcctatgctccgattgtattgtatttatattgtcgacaatttatatttataatatatcacgacagtctacatacgtcaacctgtttttagtaaattacacaaaaaaagacaccgctttgcactcagttaatacctcttatacaaagcgatgccaatccttacttatatatactataaacattcatttgacatacattcagctcatatgccgattttatctatacgcattttctggaatgccctgatactgctctccttcacattttccagatggctttccaataaagtagtagctaattccaaatcccttttttctattgcttccacaatattcaaatgctcctctttggattgcagtaaacgattaggtgtctgggccgaaattttttgaaaagcatctaattgaacagacagcgatgccaaaattgatctcatacgcgtactcatacaatatctggtaatcatgttatgtaaatccgaatctgtcttataatactctgatggtgtggaatctatctttaaaaactgtaattctttcttaacagtctgcaattcgtcctggcttacattctttacacaattccgcaaagaatatacttcgaatagtttacgtatatcacaactctcaatgatatcctcaaccgtatatgcccgtacaaacgtccctctgtttcgggcctttgtaacaaaaccttctgcctccagccgccttaacgcctcacgcagcggagtacggctgatatttaaatccctgcagatttcattttccaagattgggtcattgggcttgtatgtaaaggagataatctgctctaatatatatctgtatgcaatttcgctaagagaatctgttttttcagtttccatgtgcacctcgaatattttatccgtttacatatattctacacaagtatcaattatattgtcaagaagtatcctaattatacgaaaacactttccatcattaatgtctggaagtattttttagttattgaaaattcttttcacaatgatatcactttattataaacaatgaaaaaggttggaccctcatataaccccatggtactccaaccttttcaccgtttatatatacatagccaatgtcttatcccttacttcctccaaatgagactgaagaagctgctctgcttttgtactgtccctttgtattatggcgtctacaatatccaaatgctttttcctactctctttaaagtgacttgggagtttggcagataagcgatttaccaacgcaatttgaagagaaagtgtgttataaaattttatcaaacgtttattgccactgtaatgtacaatggtctcatgtaacgcagtattagctgaatagtactgctgtggcgtagattcttcattcaaacactcaatattacgtctcaactcctgtaatatggaatcatccataaactgacaggccattctaagcgcctgcaattcaaaaagaatccggagctggaatatctctgacaaatcctcccgcgtcatatctgtcacaaacgttcccctgttgggatagtgcacaattaccccctccacctccaacagttttaacgcctcacgcacaggagaccggcttgtaccaaggccatttgcaatctctgcttctgaaattggcgcaccaaaacttttttctcctgtcaatatctgattatatatatattcatatgccttttttgtatttccgcttgttcccatgctaacctccctcatatctgtagaattataacatggcaggcgttctttttcaagcaagccctgattgattgcacagttcatctaaaaactccatataaagaattgtataatcataattttatcaaaatctgtactacaagaataagagttataagtgcaatgggatatgttgttgcataggctgccgctacatcatccgtttctgcaatctgtgttaacatggcaagggagggtgtacatgtcatacttgcagtcattgcccctaaaccattcagcagatgcaacttcaaaatacgcctgaataatactactcctgcaaaaaagggaattataacaaaaaagaaaccgtaaataaggggaagcaggccatactccgaaagcactttagcaacgccatgtcctccctctacacctgcccccgagaaaaacagcagtaatccaaattcttttgctggtgcaatcacaccttgttcaacatgcatatcaatagggcctaattttccaatacagcttattatcactgccataagcaatggtccaccggttgtacctagagaaaaatgactctgaccaggaagtggtatcatgacggcgcccaaaagaattccaaataatgcagctagtgaaaaaaagcatatgcctaacttatctatacgatgactgcccttttcttctcccgtaatcccatcttctgtatctttaatcagcgtacgctcaaacgccatatctgccctcaaaaaccgaggaatcagttgaatcagcaacaccttgcaagtcactcccacaggatagacaagtccataaccagctgctacctgcgcggctgcggctggtgactgagcggcctcctttgctgctgcaaagccaggagaggtagtaaaggctcctgtcataattcccactgccagtggggcctctattcctaccgcccggataataaaccaacatattatactgccaatagctgccgtagaaagacataaaacagcatatgaaaagccatttctttttaaccgccttataaatccagggccggccccaaatccaactgccgtaataaaaaagacagctcccaatgtctgaagaatcgcaggcaagattaccccaaaatgtccaaagataagaccgattataaaaatacccgcatttcccagattcaggccttttattttaacgcttcctaataaatatccaagaattgcaatcacaaatacaaacataatcgtttccgatatctcattgaaagaaatcatatccaacctctttatatatatttatttcatcacttatagaaaagcaacacagtgattacatatgtaaaaatacttcctggcatccatatgccggaagtattttcaaacagtctgcccgcaaacttttacagacacactgatttcaggtatcgtattactatatcatgggattcacgccactcgtccttcatacgtatgttaaatgcatgctgactattcctaaagcgctttatcgtgacctccaccccttgtgcagccaaacgggcgccatattcttcattttcaaagcggaaactgcactttcctcctgagataatcaatgtcctcggctgggaacgcagcatatggtccgtagcataagcaggacttgcaataggcagatacggggttgcaagttcctctcctagatacagggctgtaaatcccctccctctttccggcggcatcatgtattcatagccacatggtttatattgtgggtcagttgccttgtctaggcttgcacagtccaatatctgggcacagaacctgacatcctttcgtacacctgccatcaaactcactgcagcagccatatttccaccagatgaacatcccccaataacaatatgctcagaatccactccccagctttcgcatctttctgttacccatcgagccacttcataaatttgttctaccggcaccggaaaagtgtactgtggcgtcagcgcataatccacatccacagtgatacatcccacttcatgggcaatctgcgcacaatataaagcatcatcttcgcaccatggtccatgccacccgcctccatgtatattgatatataccaaacattttcttttacattctttaggcattgtaatataacacgtaaccggcactcctactgaaggtactgcaagtgtggcctgagacgtctccacaaattccatgtgtctggcatagtcttccggaaccttacgctctgcaaacatttttgtccgtgctcccgctgtcttttccaatatgtcttcccaatactgtttccgttcaggagttaaaggcatacagtattcctccttataattcaatccttattgtcagtaatcacaggttcaacattttcagacggcggattataacctcatgggcttcctgccattcatccatcattcttaccgtaaatgcgtgcctgctattagaaaacctcttcatagtaacctctacccctaaggctgccagacgcttcccatacaattcatcctcaaaacgaaggctgcattttcctgctgttataattaatgccggcggctggctttccaacatattgtcaggggcaaatgagggggaaataaatggtgaatacgcactttctttatcaccgcccacatataatgcagcaaaggcattcatacgttctgaaggcatcatcagtaaatctgcctcaggtttatattccggcggtgttgcattatccagagcagcacagtcaagaatctgcagacagaacttaatgcctcccctctgttcagcaagcagacagacagaggccgcaatgttccctccggctgagcaacctccaatggcaattttctctgaatctgcattccattcagcacacctccccgcagtccaccgggccacctcatatacctgttcaacaggaactggaaaagaatgcttcggcgtaagagcatagtctacatccacaacaatgcctttcgtttcatgggcaatctttgcacaaaataatgcgtcatcctctgtccatggataatgaaaacctcctccatgtatgtgtatatatacagtgcagcccggacaacggttttctgccatggagatatagcatttgactggtatcccgattaaagggacatctatcatttcttctgaacgaattaccttttccatatatgccatatattcgtcaggtactgtccttaaggcaaacatttcctccctattgttattggttgtctccagtatctccatccagtactgcttttctttttctgtaagagccataatatacccccatccagtcaaacttattgatatgtttaagcattatacaagacttgtaatagtggtaaacaacgctgtctgcatgaggtcaatcaaaaatgcaccaatcaacggaactaccagaaaagcttttggcgccggcccaaagtccttgcggacagcctccatattggcaatcccggtaaacgaagctcccataccaaagccgcaaacacctgccgatataacagcagcttcataatctttgccacagcaattaaatacaactaaatacgcaaatataataatgactatagtctgtacaaacataacaattaccataggaagtgccaaatctgctaactcccatagattcacagacagcattgcaagactcaaatacgcactcaatgcgtatccccccacaacatccagttcatcgtcaggaagttctgtatgccttgcatcacagacattccggattaccatgccaatggccagtgttccaatagacatggcacggaatgggatatttaatgctgcaattattttaagaaggacatcccccagcccaactgttaatatcaacaggaatgctgccagatacatttttttcttattaagaagggggattcttttatccggctgcatttctgtctccaccgtagcgggcacctcttgggccccgggatatgataacctttttctggaaattaaagtctttgcaataggcccgccgataagtccgccggcaatcagaccataggatgcgcatgcgatgcctaccatgaaagcattagtaacccccatattgtcaagaaccattccccagtttcccactgtaccatgtcctcctacaagaggaatagaacccatgcataatcccagaagcgggtccaagcccatgattttggcaaacaccacgccgattccgttctgaatcagaattaaaaaggcagatgcaaatgacattatgacaagtatcttcccacctttttttaatagtttaaacctgcaattgaaaccaatgcttgcaaagaatacatacataaatacgccttgcaccgtactatccataataagtgtgattccccccatatagaggaacagttttataatgactgcaatcagtcctcccacaacaggagccggaatacaatatttttccaaaaacttgacacgtttgacaacaaaacatccaagatagtaaacaactggcgccaaggccatgaactgataaagattgacctttatttccatgtattttcctcctttgtctatgttaagtgattcaaagcccgttccagccgttccatcccttctgctattgtctcaatggaaaccgaatatgcaaaccgcactgtttccggagcctcgaatgcatttcctggtacgatagcaacttttgcctcttccagaatataatcacacaaatctcctgcgttctgaattgaccagtttttatatttctttcctaaataataactaacattcggcattagataaaaagcaccttcaggctttggacactgcattcccggaatcaaattaagacgctcatacatgaattctcttcgtctttcaaactctttcctcatagcctctacttcttcttcacattcctgcagcgctgtaatggctgcccattgaataaaggttgtggagttggtcgtaacatgtccctgaagggatgtcatgcccttaatcacatcctttggccctgccgcatatcctactcgccatccggtcatggaataagattttgaaaaaccatttactacaatggtcttgtcataaattcccggagataaagaagcaatactcacatgttctacattcccatatatcagtttttcataaacttcatctgcaattatgtaaatatccttctcaactgccaactgtgccagctgttcaagagtgtccctggaatatactgcccctgtaggattattcggtgtattgatgataattaatttagttttatccgtaacagcatttttaacttcttccattataatatgaaatctgtcgtcagttttaaccagaattggaaccccgcccgcaagtttgaccatttccacataacttacccagcagggtgtgggaataatcacttcatctcccggattacacagagccatcacggcattatagacggcttgctttgcaccggttgacacacaaatttggtccggagtataagtaaggttgttatccctcctcaatttctcggtaatcgcctgacgaagttggataattcctcctattgcaatgtactttgtctttccctctaacatcgcctttgtacatgcgtctgccactttttgaggtgtagggaaatccggctcccccagattaaatgccgctatgttaattcctgcccctttcatctctgatattttccctcccaaagtgcttgttgcagacggggtcatgtccaagattctttgtgataccatattctactcctcctcatattttttctctttatgtttcctcttagcctaatacattcataaataaagtaataacagtcgaatttacaaggtccgcaaacatacttcccacaatcggtataatcaaaaatgccctgagcgccggtccatatacgcttgttactgcattcatatttgctattgcattaggtgtggcgccaagaccaaagccgcatgtgccggccgtcattacagcagcgtcataatcacgtcccaggctattgaatattataaaatatgcaaacagtccaaccaatactgtttcagctaaaagcgttacaatcattggtatggccaaacttgcaagaagccacaattccatgctcatcatagccatggaaaggaacaggcttaaagatacatctccggtaatctcaatttcttcatctggcagaacaattcctttacaatcacagacattacgaagtatgcatcctgcaagaagtgaccctactgcagcggaaaaggtcatcagccggttcaaaatatcggaaattattgtacctaaccctacgcaaagaagaagcagtgccacagccagcattattttttctccgctcaggatattatgagttttctcattgacaaaggcttcatcttcctgttcatgcgtaacagactttctattaagctgcatgattctgattctggccagaggaccgccaatgacacatcctgctacaagaccataggtcgctgccgcataagacgctgttgctgctgatgctacgcctgcttgttcaatcaggacaccaaaggctgctgccgttccatggccccctaccagtggaacagaaccaatggctgtgccgagaagtggattcataccaaaagctgacactatggctgcccccagaacattctggagaacacacagaatccctacaagaaaaataatgataacgagttggattccgcctttcttcagcaccttcatccttgcattaaatccaatactacagaaaaacacaagcataaacgcagtctgtaacgttgtatccatagtaagaatcagtatccctgtcacatgtaacaccagtgttgctgttgcaaaaataatgccgcccacgactggtgcgggtatacaatatttttgcaggaaaaaaacttttgttttgataaatttaccaacataatacacaataactgcaatcgcagttgtcaaaaacatgttcaaagatatttccatattttctcctttccctaactgcatatacctggacaaagggccgggaatatgcctgcgcctttaatcgtatttaaattgtcgacattttatatttttattgtataatatctcatttgctttgtcaatatgataatattatatattttttttacgaacaaaatattaaaaatgtactattttcaagaatatccgaccataatattgacatatttaactaaatgcaatataatcgccccatacattgtcgacattttgtgtttattttttcaactcttcatgggggtactacttatggataccaaaaatcttattacctttgtcacatttgcaaaagaaaaatcgtatttaaagacgtccatgcagctccactatgccccttcaacgttaatcgagcatattgcgcaactggaacaggaactaagcatcaagcttgtggaaacagtgggacgaaaaaccgtattaaccaaacagggaaaacaattcctgccttatgcaagtaatattcttgaaagtgtaaggattgccaaagatgccatggataatacccaatccctgaaaggaaccataaccataggaatcattgaatcaatggctgcctataagatgtcctctgtattttccgaatttcttgggtatcaccctaatgtcaacttaattattaaaacaggaaacagtgcctcgcttcctgaacagctgagaaatggtaattttgatgttgtctttttatatgactgcctgtcccccatatatgaagggctttttcagcatcttctcttccaggagcgcctgcagttctgcgtttctccgggtcaccggctggcttttaaagatgaggttttacctgttgactttcgccatgaaaccttcctctatcagcatgaagattgctgctattatgatatttttcaggaactaatccaaaaagaaaacctgaaaatcagagaccgcctgcaaattgaaagcggaatcctgattaaaaagtatgttgccaaaggcaaaggaatctcaatactaccaaaaagcatgaccgatgaagatgtgctggacggcaagctggtatacctgaattgggttggtgaagaaatgaaaataaacggcagaatgcttacatcgagggagcaatggaagcctgccgctgttcaaacatttatagaatttgccaaaaactatttatatcaaaattaagcattttacttcatcctgtatctgatacgtgtcttctattcttctccatccactttctcctctttaattcctcttgcgtttaaggccactttatccaatgattgaaaatgccctcagtataataccgaagggcattttcatcgaatatgtagggaaacgaatcaacatatcccctgtgccaacatcgcctcggcaaccttctgaaaaccggcaagattagcaccagctacatagttacccgggcaaccgtatcttgttgctgcatcatcaatgttatggaagatgttcttcatgatgccctgaaggcgcatatccacctcttctcttgtccaggcaagatgttcggcgttctgggccatttccaaagaagacacggcaacaccgcctgcatttactgctttagacggaagaaccgatataccattggacatcaacaaatctaccgcctcctgtctggtaggcatattagaaacttcaataagatgcttgcaatgtccttcttcaagaattcgttctgcatcctctttgccaatctcattttgggtggcgcacggcatataaatatctgcatttaccctgccccatggtttctctcctgcatgatattcaacatggtatttgtcagcatagtcttttacacaatccctgcaggatgcccgcatctccagtaaataatcaatcttatcaccggaaataccatccgggtcataaatgtatccatccggacccgagagcgttatgaccttgccccccagctcatggatttttttacatacgccccatgagacatttccaaaacctgatacagcaaatgttgttcctgctatttctttatcaattgtcttaaaatactcctgtgtaaaatatacagctccatatccagtcgcctcggtccttcccaatgaacctccataggagagcccttttcctgacaatgcacctgcctcataggcaccacggatacgtttgtactgtccatacagataccctatctctcttgcccccacccctatgtctccggccgggcagtctgtatcaggacctatgtaacgatacaactcagtcatgaatgactggcaaaaacgcatcacctctgcatctgattttcctttcgggtcaaaatcagaaccaccttttcctccgccaatgggaagccctgttaaagaattcttaaaaatctgttcaaacccaaggaattttataatgctgatattaactgtgggatgaaacctaagtccccccttatatggcccgatgctgctggaaaattgtacgcggtaacctctgttaacctgtacttttccatcatcatctacccatggtacacgaaaagtcactgccttttcaggttcaactatcctctccagaatacccgccttttcatacctgtcatcattgtccataattggacgaagagaattaagtacctctctgactgtctgaagaaactccggctgttctgcatttttagcttctgttgctgctataaccctatctacgtatgacatcttctcctccttgtaatacacaccttgtatattcattttcaagagctctttcgatgatttcattataaaagatattagagtcagtgcattcggtaatcccgaaaacgatgttcggaaatactgaatccattgtcatgaaaacataacttgttttctattaaccaattccctaattagctctgcctcttctgtccacaatgaagctgtagtctgtctgaataattcctacgaatatataatgatattattttcacaagcaaccagccaattgtgcatactcgcatatctatttaactgagtcaaaaaaagtgatacagcaaatactattcttttgctgtaccacatctcttttattaaccatactattcaattggatttgtcccacatatgtccctatatccgttaataatcagttgatatactatatgttcatctttattgtcaagatttagagaacaaaatctacagactgtacgttcaattccattattcctaagatatgtccgtaatctcatggattgttcatctttttcattttcatacaaaaaaacataagcgcaacagcgggttataaagtatggaattatgccatgcttgacacaacacaacgcaggtccaatgaagcggtcattctttccaagttttcggatagggtcacggacaattcgatacaggctatcggaaaaatgtttagtacggaatacagtcactggctgacgtgcctggtcttcattcctgggaggaagaccatattgggccatgacagcctggtatccttccacagatgcataatatgccatttgggatgcctgcatatcgtaagcggcatcatacgtatttgtaattcctttagtcaatgctacaaaagccatgctgcattgtaccaggttacctgcccaaattttaattgccatagctccatccagcccttgctccaagcgaaaaaaatctggtctagaaaaatcattctccaactcaggtatattatcaacccgtagtatagccttgtcatctcctataatacgaaatgtatcctctgtctgttcgagaatgtccggcagaagattcttcctattaacaatgctcatcaccaggataaccgtatctttgtaataagagtaggcttcacccaaaagccttttttgtaaacctgtctcaaaatattcccttaatcctacataatttgctcccagggtaatcatcaagcggccttttataccgtgactcatgcgaaactgaatggcttctgataaatcgtccaacgcgctgtcaaagtcttccggccgtaaggcagtggaaactaaatctgtatcagctaatgcttccatatactgctggcgctctgtaacagtattaactgtgcgatatcctgtaattttacgctcctgccgggttccttcctttaaatttgtcatctgcactgtataatatccctgttctctcaacccctcagtcaaatgtgttttcggatctgcaaatataatctcatacccttccctatcatatagttcccccagcattcctctcccactgcgaccggaaccgattatcacaacttttttccgcaatatcccttcacctcctttatatcaggtaaacaaccgctttggattctctacaaatatagtatgaatttgctcatctgttaccttcttttcctttaacattggaatcaccactcttattatatagctgagggaatccggagcatagtttatatattgtctatgattccaatcagcccagcgtgtcgagttataacaaattaccgcatcgtgagatagtattaactgcgaagcatatcccttttggcataatttcacaattgtcttaatattgaattccagatgatgtgcattgaagttcatttgatcaatagccagatagctacctcttttcattacattttctgcatagtccagcgggtctccctcacgaaaatgacctataactactttggaaagatctgctccctgctcctcgaatatatccaactggaacaatccttgcctggtattttcaggtcggcaatgagtgataataggcagaccactctccttttgtgcctgagcgcaggcccgaagtatctttttattgtttttcgtaaagccaaattctccagtcccacatttaattacaccacatcgggatattgttccctgaataccacactcaatctccctcattatcatcttaagcatattaagttcacttatatggtttacccagagatcttcgtctacatagacgccggtagatgcaattatatttaggccgctccgctctgccgctgcctgcatcaaatctacatcacgtccaatattcaatggtgttgcatccacgattgtctttacaccatgacgtttagcatccatcaatacgccacatatcatatccagggcttcttccctattaaaccactcagaatcagcgatacggttattccagttccccaaataaatgtgttcatgcatcaatgtgaaacctaattctgacacgtctaatgtgccattgaccgtttgtgccttattcataataatgcctccttaaccaaaatagaatggtcttctatgaatcagcatgtaaatgtggtctgcagaattcaaatcagcataatgtaaaatctgggccataggatcttctacatggtgaaaactcttgggtgagtgggttgctaccaaagctactatacgattcggaaatcccaactctttcagtagcatagcacctagaacaccatggggtatatcctgagtatatccctcacttagcaacaatggtttgtcaatatcgtgaagcaacagaagcagcagaagctcctcacggtctactttttctgtccagccatcattccattttttttcagcatattcttccatgtgaagtcccaaatcaaccacctcattgacatggtccacaaacccataatgagtacaatgagcagaaaagggaatttcctccagcgtagtaaatgtactgtttgtcagtacagtatggtacgctgtcagtactctttccctattttcttcttccaactgaaaaattcctggaaaacatttgataattaccgatttatcggcttcatccggatatttaatctggtacattatttacatcctttctgtcaatataagagataaaagccaaatccatatttccagacaaatcaaggcaaccacttccgaccggcacaaaaagagtgtccgccggttttattgtttcaccacaaatagttcccttcccatccacgcacgttataaaataaaatcccctatacgaaaacacaccctcatccttatttttaatacgctttgccacatactcacctggtacgctgtgatatgtagttatctgcacgccattcttaatcaccgtctccccatcagtggcagaaagtggcagttctggtatattgacacaatcatatacttcttgcagatttaaaggccgttttgtatcattcctgtcataatcataaaaacggtatgttacatccccatttgttccaaatgtcagtttaatggttcctctcccaataccaccatgaatcacacctgccggagtatgtacaaactggccatcccgtactttaagatggtcaaacagatgctcccaatcttttgtctctaccatccgtttgaactccgccatattttttgcgcgatttccaaacagagttgtatgaatctcatcagtagcatgtattgccacactgccggataccttccccttttctccctgtcgtttcatcgcatagtcatcatccgggtgtagctggtaagattgctttccttcattgcatgtggttgtcatgcgaatgggaaagatgctttcatgacatccaaataaatccggattatttgcataaaacacggaaagcggctgtcctgtctcggcaaccatgttatccaactgtcctggtattgcaattacatgataaatagtacctatattttcctggtccgtatccagatgatactggtcaatcaactttcttcctccccatacaaatgatttataaagaggcaatatatgatatatttttttctcagacattctaatctccttaaacgattccaataaccgaaagcaccacaacaccaatgatagttccgtacaccagccatgtcgatgccacctttttatattttattaagtagtacaaaaaaaatgtgtacagcaggctgagcaggtttggaaagatgctgtttatcatatcaagcagcttggtttccacgccatttgcttcaaatttaattcccaatgtcacaccacaccgctgagcagacagacagccgacaattagaataccaaacatagctactgcttgagtcagatgggataatgagttcttagaaatgacttcaaaagatttctttcccagctgataacctttattgaataaaatgtagctgtatggtactaatatgcctgcaatagccaccaaataaaacaagggacctgcaacatttccgctatctccacacaaggacagagcaatagtaatcagaatagggattagtgttgcctgaataagactgtcgccaattccagctatcggcccttgaagccctacctttaaactacggatagtctccatatccacatctctttttagtacccgtcgttcttccagtcctaaaatcattccaaacagcagggatcctgtagcgccttctgtgttataaaagtcaaaatgcctggccatgctttccttatattcgtcctcactgcaatacttcttaaaaaaaggctttagccaccacggccaactttttcccatatagtaaacatagtcaaatcctggtgcattatattgaatgtaacggcgccataacttattgcggtcttttttagtcaataattccattctatcttcctgtttcatttctactgccataatcagattacctcctcatcctcatcgaattcttcagccttagcaatatgcttttgtttgtctccagttctataatagagatatgcaaataccaatgcaaacaaaaggatagacgtggaattcaatcctaaatacccataacaggcgaaccctaacgcaaaaatcaccaggccccagacatcatttgccaagaataccaataaggtagccattccgatacaaggcagaaaagcccctactgaattaaaggcagttaccattctggcaggaagcatgctataaagattctccacaacgccagctccataatacagtaaaacaaaggatgtaagacctctagtaataaaatagatgatggtaggaattccaaggtaaccccaaaatatcttcttatcgtttccttcctcacatccttttctcatcaaactaccacaaccagtaagaaaggctgttctggaaaatatctccaaggcattaaacaatgttcccaatgctgttgccaatgttatagctgcagcagtatctatatcagtcaaaatcgccaaagcaacacacggaaaggaaataattcccaagtcgatagacgaaactcctcccacattaaagtagccaatataaaccagctgcatagctgctcccacagcaacacctgtggatatgtcaccaagaataataccgcacaggagccctcctataaaaggcctttgcataatatacttggcgagccatcccccccacggagcagttccgcttgcagaaaatacggttaacattgctattaatccacattgtaaagctaacataagtaccctctccttttacatttgttttcatttgtttcgtatttcctgccagggaatgttttccaacttacagctgggatccattaccacttccactccctgcgccaccaagaaatccatagcaaccatctcttcttcagtaaggcccacaccctgcatgatgcttactgagttctcccgattaaattgttgcccacacgttaccggaagtttaaagcggtaccctttacgaaccagactcgcagttgtcaacggatttctaagaatcacaaaataattcctttctgagtcctccgctttcttaagttgttcaattcctttctcttcgtcaaaaaagtacgttttaacagaagctggcgctgctgctgcaaacacctttttcatcactgaatctctggctaaaatttcatcaattacgatgattccatcacatttgtaatgattctgcaatacagtggtggtttgcccatggattagcttggcctccattctacagtagctaatcataaatatcctcctttatcataaaagtttatttgtccattatcattatactttacattcttaagctcttattgtataatgataatagttttcttaccatataagaataatactaccactatttgatttaatgtcaatagttttggcactatttattaaaattcatagtttccagcccgttaattatacatatttttgtgtcagtttgttattttcttatattatgataattttttatctgatagtatttgaaatcaattgaatttcaactggaaaatacgtataatagaagcaataccatatataatgttggaataaccaggagattatattcaatgataacatattgcagaattgaagataaaataatacacggacaaactaccactgtgttacgcaagcattaccactttgatggtattatcgttattaatgatgagattgcctctgacctgtccctaagaaaaatttatatagctacagtaccagatattaaaatctacttttttactctgacaaagggaatcggacaacttagaaaggctgacgcttccacattgaggtacctggtaatatttaaagatcctgtttctgtagctgctataattaaaaaaggataccactttacagtagccgtaacctgcggtcagcaaatggaacagcaagattcactgccaatcatgcaggggctgagtctctcacagaaacaggtggacgcattacgtttcattgccggcgcaggggttgatttgagatttgatcccgattgtactaacgacaatatttcctggaaaacctttgaaaaatatgtggagaatgctcagacaaaggctgcaaagggaagtccaggcagcaagaataccagccttaataagacattttctattctggattgttttctttctgaagaatgtaaggaaatgtctcccgcccagatacaggcagcaacaggcattcctgtgtcgacctgctacaggctgattgaatttcttgaacaaaatggatatctgcaaaaaaacaaacgcaacaaaaaatattcccttggatggaagttcatgcttctatcatcaaatgccggcaccatacatctacctgcatttgatgatattgtccctctgtacatacgcaacgtcagagacaagctcaacgaatcaactgctctttttatccaaattggattcaaagtcaaatgtatctgctgtgaggaaagtcaccatacaattcaggcccgttttaaaaatcaacagataagtgatttgacgtttgacactacagggtgtgtatttttgtcctatctctcaccggagcagagggaggcttatatgaatctgacagaaagggaagtcgaagaacttcgctgtgttttagataccggctactgtattcactataactctgatttagaaggtacatccgcggtatctgtaccagtaatgttgtctcaggacaatatgattgctgtacttactgtaaaagggcctgcctttcgttttaatgaaacaatggggccttcagagattgcagaacttatcaaaactgcaaaagaaatatctgataactattcaaattctattttataatattggagtgttaatcatgaaaggaattttattaattagccattttgatttggcttctggaacattaaacgctgcgaaactaatttttggggaccaattatcccagatagaagcaatagggttatccatgcaagataatgcagaaaattttaccaaccggctcaaagtagcgttggcacgattggataccggagatggggtaattatactagctgatttgttaggcggtaccccctgtaattgtgctgccccgctaataggcggaaaaatacgtatgcttaccggattaaatctgccactactgctggaagtcctctgtgaaagacagaccagcgattttgaaaacataggaaatttacttgacagggtaagaagaagtatacaagaatatagtactaatgagccagatacagaatataacgaaattatataatatgttcgagcaaaagcaagtatcccgatatatccatgaattagaaaagcggggttaccttgtagcgcaagagtgtgtgaagaaaagtctgtaaaagctgatcttctatgataataactgggctgaaagttctttcttggaccttcagtccttgttctgtcatttgtacctggtgtaccggtttcttttctcttgccataataaaaggcctcctatgattttttattttatcatagaagacctttggctaatacctatttacagaaaaattttcatacactcattaaccggcagcccactttattaagtctattttcaacttgcgttcattgaatttgcttcctcatactttatgaggcatcctctaataggttgcctgatgcgcaataagctattagagcagaaccgttatcagctagtgaacgaatcaaaacaaataatcttctacaaaatccactacgccttgaagccgcgatttgatttcccgcatgaccttacatacctcttcctcatgcttactatcaattgtactaaatggaggccggcatattccggccggcagccccctatattgcatagccagttttaagggtaccggatgtgacgccttatacagcacatcatctaaaagcttaactgcaaagtggcattgccttgccttgtcatagtcttggtccgcaatggccttatcaagcgccatgcatacttccggtatgactgccgccgtagccaggataccaccatcccctcccagtgccagggtcgggaaatagagattatccccgcctgtcagaagcccgaacggatgcggacacttaatacgaatatcctgcatgaaaaccatatcaccggaggattccttaatccccacaacttcttgagtcttggacagtctttgtatcaaatcagaggacatactaaaagcagacctgctgggagtattgaaaagaatcaagggcatctttaatgtagcatattcatttatcaaccgttctacgtcacgttctgaaggccgtacaaaagggggggccatgacaagacaggcatccgcaccaagctccttagccttttgtatatcatccatgacatccgatggccggcccgccaatgtaccgaatacgacatgcatcccctcagagttttttattgtctcttccattaccatatgacgctctacagatgtcagggatgctgcctcaccggttcctcctaatacgcagatactctttactcctgctttcttctgaaattcaatcgatgtctttaatccgtcataatcgactgccccatcattcttaaaacatgtaaccatcgaagaaatgattccttttggataatacattattttcctccttcatataactttttatacagtaactttatctgggtaaattatggtcgcattattaatttccctgccatgcagatagtccagcgctccctgtatggcccatacgcattccctatatgcagattccttggttctcgccgctacatggggagtcatgataatattatctacagtcctaagaggatgatccatggccagcggttcctttgcgtatacatccaatgcggccccgctgatttccccatttctcaatgcatcaataagtgcggtctcatcaatcatacctcctctggcgctgttcacaagaatcgcagaagatttcatttttttgaaagcatcttcattgaacatcccctttgtatcatccgttagaagacaatgaattgacaccacatctgcctgttttagtaattcttcaaatgataccctcttgatattctccctttcaaaaaccgcatcctccatatagggatcatatgcaatcacacaggactgaaatccttttagtatggatgccacctttctgcctatcgcaccaagtcctatgattcctatggtttttccgctaatatcaccgcccaaaagggtctggtccctccaaccgccttccaataacgcatcagcagcctgtatgaaccgtttacatgctgccaacatcaacagcactgtatattcagccacactctgggcgtttgcctcaggagtccatcccactgctataccattcatacgggcataagaaaaatcaatattttcaggccatgcgccggacttaaatgccacttttagttctggcgcttttttcattaaatccgctgtgattgaattgctggaattaaaaataatagcatctgcagttccaatgaatttcaacaattggctattgtctccccgtacccccttctctccttctaacagctcacattcctctaatatccacgccggtaaatccgacctttcaataggaagctccggtatggcaatcttgaactttttcctcatagtccttctcctattcattttagcattgtttttcaactaagcggtcatccctcaacagaacagatttaccatggtcgtattaagtaccagtaacacccagtccatcatgattccacccacaacggttacacacagataggaaatcttactctcgccatatctctgggtcacactatccatattagcaaagcctgtaggtgaagcccccaggccgtggccgcacattcctgcacacatgatagccgcgtcgaaatccttgccgcaaacacgaaataccacaaaatagaggaaaagcaacgtacacccaagtccaataaagagtatgataatcataggcacagccaactcggccagttcccacagccttaaagaaatcattgcaatggacaggaacacccctaaagtaaaatcttgtattccttccataatatcagggttaatctccagccattctgtatgttcatttacattactgacaacacaggccagcagcgcgcctccggcaaagtctggaatcgtaattccaaacaactggtttaacagggatttaaaataaatgccaatccccaacaggagacacaaaagggcaatgtgttcaaatatggaagtgattgttatggtctgctttggagccttctctgccatagccctctctgccagtgtatcttcttcatcactccccttttttaccagaccgtatcttctaatcagacgttctgcaatggggccgccacacagacttccgcttacaagtccgaaagtagcggccgccatccctacaacactggccgtatatcccatgttatccaggatagcaccatatgccgccgcattaccatggccgcccgagagcgcagcaggtccacacatcaatcccagccaatctccagcatgtacagccttggcagcaatgactccgattcccccttgaagtacagccaaaattgctgccatgaaaaaatatttcactaaacggctcccacctctctttaccaatgagaaggtgattccaaatccaacacatgtaaaaaaaagattctgcatatccgcctgataagtagtaatcatgacgatattaatcctcccggtctcatgaaggaccagattcagaacagcaaatatgaccccacctattactggacttggaatacaataccgctgtaaaagtgccacccggtttttaatttgctgccccatgagcaacatcaacagcgctacagctaccgtagtaatggcagtaaaactcacattaaaaataccattctccattgtaaagagcattgttactacatccccctttctactttttgagttgataaagaagcttctttctgtatttagcatatcatataatgggactcaacagaaatagacatttctgctgggtcccatttaataattcgataattcgtatataatcaaaccttaccaatcctaaaaatcagttaccaggtctggaatttgtgaaacaaatatttctaacgccccctcaaatatacggagactctccatttttgacactttaggctgcctgtgtttaatgatatagcatgtcctttcatatggctgcggcagttctaattcatcgacctgcacatttccggttccgagatagaatctttgcagcagacttcctggtatgatcgcccaatatttttcatcggtcaggaatcgctgcagcagggaaacattatccacccaagcatggtataaggtggattcaccaaagatttgttcgtgccatgcttcgtaatccccaccccaatacatataaatttcataacgggaatctaaatcttttggattaatccttcttacagcggatggatatttagcatagcgaacaacgtaatatttctgtttgaacaagggttttgtaatgacattcttcctcttgcatggctccgctataaaaccaatatccgcggttttgttctccacaaggttatatatctcggaagaataggcagttatgattttcaggcataaaggccgttccccttcagaaactgcgtaatacacatctgccaaaacagaggaacctatactatcaatagcacctatcgtaagcatattctcaggataatatttcaactcctgtgtatcctgataaacggaacgccatttttcggctacaggtatgaacaattcgccataacgcgttaattcagatgtccgtatacctttatttctatgaaacaacggaattcccaattccttttccaactgcttcaaccggtagctcactgttgattgtgaaaagtgcatactctcagatgctttggttatgctgttccattttacaatcgataggaaaagttcgacgtccacaatatccattccagtctcctttttgttatttttttattattaagattgttattatatatcgaaaattataacaatacaagattagtttacgcattattgccatgaaaagcaataccaaagatttagtacccgggagtttgacaccccctaatctaaaaaacgccgctaagccgctacaggcttatattttttcgtcaaattttatacttttatatataggctttttagtctttttgtggtataataggagatggaggtaattgctcatgaaggttaatacatctaaatcaaagaatgccgaatccttttacatcaagcagtcctatatagactgcaacggaaaatccacttccagaaccatccgcaagcttggaacattgaatgaattattagtggaacacggacctacacgggatgatgtcatggcctgggcaaaagaacaggcccgtatagaaacagagaaatacgagttggaaaaggaaactctctccattcccgttgtgtttcatccgaaccgtaagattccgcatggagaacgaagatgttttgacggcggttatcttttcctgcaaacgatttattacgaactaggcatggaccgtatctgcagaaagattcgcagcaggcatcattacgaatacgatttaaacgccatactttctgatttgatttacacaagggttctggaaccaggcagtaaacgttcttcttacgcggccgcaaaaaaatttttagagcctccaacttatgaacaacacgatatctatcgggcgttaagtgtcctggcttcggaatgtgacctgattcagtcagaagtgtataagaactcaaaatccgttataagccggaatgaccatatcctctactacgactgcacaaactactattttgagattgaacaggaagaaggagataaaaaatacgggaaaagcaaggagcaccggcctaatccgattatacagatgggattatttaccgatggggacggaataccgctggccttttccacgtttcccggcaaccagaatgagcaaaaatccctggaacctttagagcagaaagtcatcgaggagtttggctgcgggaaattcatcttctgttctgattccggacttgggtcagagaataaccgcctgttgaaccacacaggaaaccgggcttatatcgtgacacagtccatcaaaaagctggcggcagagtaccgggaagctgcgctgaatcgaaaaggattccggagactgtctgacaacaggctggtggatttagaccaactggatgagaaggactatgaggaattgttttacaaagaagaaccctacagtacaaaaaaacttgagaaccggctgcttatcacctactcccctaaatatgcagcctaccagaaagaaatccgtacaaagcaggtagagcgtgcgcttcatatgttaaaagacggaaatcataaaaaaacaagcaaaaatcccaatgacccggcacggtttattgataaggcggcggttacaaaggatggcgaaaaagctgatatcctgtattttttagatgaatcaaaaatagcggaggaagaacggtatgacggtctgtatgcagtctgcaccgacctttttgatgataatcctgctgacctcttgaaagtaagtgaaggaagatggcagacagaagcatgcttccggattatgaagacagattttgaagcaaggcctgtttatgttcgtagagaagactgtatacaggctcactttctgatttgttttctatcgcttttagtctaccgcttattagaaaaaaagctgggtggaacatacacctgctgcgaaatcttagacacgttaagaacgtttaagtttgcagatgttcaaggtcagggattcatgcctgtttatgaagtaacagcgctgacagatagactgcatgaactccttggttttgccactgactatgaatttctcacgaaaagccggatgaaaaccattgaaaaactcagtaagcaaaggtgaaaccagttctcttgccagcaggaagagtcattagctcctgtgaacaggtgtaataaaaactttcatccgtgccctaaaagggaaaaaagactatacttgaaaacaaagcaacaccgctgtgaaacctttatagaataaggattccaacggtgtttgaatttttttactgtcaaagatgggagtatatcaaaaatacagttaaaaatgaagtgctgtatatttactatcataaaacacagtgtttcaaattttgttaaactacagaaagccaatgacccgacaccctcttttccccaaaagggctaacgtaacgatgctacatgattcacttaatgttacggactattaacttgcacctattccacataggcacacatcgcttcagcacaatcagttgcccaaaagcactggacgcttgttacggagctcactggcaattactccgaccagactttcactggcaagctgttgacagctttcagaacacacgacttacaccggttagaaacgtgtaccgccgggcacaccaatagatagggattgccttcacgcatgtggcaatccctattatcacaatctattcatgatataattgtatattcatcccgctggttttgaaggaattctaactcaacatcagttcagatgataccaataaaatctctgctttcagaggtcagaatttttaatcattccattccacaaccggtttttcaagaagccttttgtagtaagaacctgtctgatacagcgcaaccgcgggattatgaccaagtacacgatcctttgtaatcaatgtggtcgtcagggcctcggcatatttatagaacaggctgtcatgacccacgcacagtcccacgaccacatttagttcggttcctgcttcatttaacttttttgcctgtagaatggggttgcacataacgggtcctgtctttgtgtattcttcctccagaccaatggatgttttgtccttagagcccactttgcagattacgccatatacatcaaatccattgaacctcaggatttttgcgaagacacggctctcctctatcagccctgaacaggtggctattccaatctttctggcgcctatctgtttcgcgaactccatgatttcttccacacgtgtatagattcccgagtattcagattctacctgcgcacccgcgattgccactctgtggttctcgtcgtcatccatatacagtttctccagttctgctgcctccttctgtgtaacatcctgtgtcaggcagaaatccggatattttccacttctcttcttgcagtttaagctgccgcagtctacacagcttaaggtttttccattattctgagcattcataaattctctctttcatcgctgaagtttttttttccaactttgcggcacggcgcttctccagacggtctacgataacggttgcggacatgtcaccaagacagttcatggaggtggttcccatatcgaagaaacgatagaatcctcccaccatgagaacaatatccagaggcatgcccactgctgttcctacaatcataagattcatcagcccgcctcccggaacgccggagcccgcactggtaaccagggttgtaacaaacagaatgttaataatctgcgtgattgtgagagggattcccatggcctgaccgctgaagataaggacaacaccacagagtattgccacgccatccttattgacggtcgctcccagagggatgcccagagatgccactgattcgtcgcatccaaaattctgtgtggcaacttccatgctgaccggaataacagcgttactgctgcatgtacttgctgctgtagcaaaggtgttaaatgcctttcttatgaaggtgattggactgatacctgtaagcatccagagcagcagacagtaaactacgattagatgaagcgcgcagcacagataaaaggtaccaagaatctttccaatggtgacaaggagtccgacaccatattttcccagtgacgatgccatgaggcagaatacaccaataggcgccagctttaaagcaatattgataatagacatcacaaggtcgctcatagccacaaaccaatcccgcaccggctcccttttaccttccggcagcagcacaatggcaacaccgatgatacatgaaatgataacgacctgcatcatatctccggaagagaaggtggcaaaaatattgctggagaacatactcttaaaaaactctgcaattgtgggcatctcattaaccacaatctcctctgtggcaacctcatagctaaagccgctgcccgggttgaggatactggtgacgccaatgccgagaactcctgcacagatggttgtaaaaatataaaatacgattatttttattccaatcctgcccagggcttccgggctgtccatgctgctgatgccttttacaagcatacacaccacgatgggcaccaaaaacatcttcattaagttcagccagatatctccgataaatccgatatatgacgctggttttcctataatgatacctgccagcgaacctaagagcattgcaatcagaatcattgttatgtcactgattttccttttcttcatggtttctccccttacaatcattatttttaattttcattcagtatgaatcgctcatcctttgccacggcccacagctttccatcccggtaatagtggcggtccagatgggcggatatctcggtccagatacgtggaacagttagtccccattcttccatacgctgttcaagagttatttcttcctcaccctggcggccaagaatcacaatttcatcacccggctttgcgtccgggaagtcggtaagatcaagaatggtatgttccagtgaaacggtgctggcaaccggacactttctgccatgcaaaagaacatatccccccgcaatcttaggactgattccatcacccatgccgcccaccatgataccaattcgttttggtgtatccattttcactgccttatatttttctccaaatttcccgcctgttacttcatttacgtggaccagacgactcttccagctgaccaggggtgctttcagctccggatgttccgctcttctcgtcaatggtgaatatccccacattgcgcgtcccggacaaattccgctcatacgtatatcaggaagtgcaatacagcccggcgtgttggccagctgtctgaacggaatccgatctgcatcctcaccaattgcatccatagcggccttaaaacgggaatactgccatactgcgtaatccgcaccctcatccggccagttcaccgccgccatatgactgtatacgccctctacatgaagattgggcatttgggaaacttccctgaaaaagtccggaaattcctcggcattcacaccaattcttccccttcccgtgtctatcttgataaagacatcggagggttctgaaaccgcctctgaaaatgacctggcggcctcaagggacaggatggtaggtatcaaatggtactggacatataaattagcagtctcctgaatcagattgcttgcaaaaatcagaatcggcatattaacaccgttttctctcagcaaaataccttcatctatacttcctacgcccagataatccgctccacactcttccagaacctttccacaggccacaataccatgactataggcatttaccttgatagccggcataatctttacatccggacccaccatttttttcaggactaaaaaattgtccctgagattgtccatattaaattccagccagcaaaatctgctgatttgataatctttcatcttcttaatcctccgataactctttataataattgattagacatcctttcaaaagaatgtcccgttccgcctttgtcagattgcccatcatcatcgtcatatcaaacgtttctccagttccggtcagaacttttgcgggtatctccctctgattctccttaatcatatcacgaataccaggtataaagatataatcccctgtcccgcagggcaaatccccgccttctggaagcatgaatggaagaattccccagttgatgcagttgctcctgtatctcttagtggcatattccgcacatatatttgcaaggccgcccagtaccttctggcaggaggctgcctgttccctggctgacccgtcgccaggcttcactgcaaaaagacaggagccgtactgtgtattgccggcaagctcttctgcattgccgaaatgtgagagcacattcatcagatgctccggcgtattcccttccatacgcctcttttcatcagcctgaatctctctgcaaattccggcaaatcccggtacgcggcggcataaggtataatccgcaagacggatgggattagagcggtaggaggcagtatctccggatggaatcagctcatctgtggacgtcaccttatcccggatgacagcagagagcttcagaaggcaattttctcccagcggttccatttcaggccaatccactatattgggcccggatacgatttctacagacgggtctgccttgccgtatccgtagaatactctcttttcataaacactgcggtcaaaggtatatgtcatatcctgaaccgtatatgccgcatccgtaccagcggtaatccgccctccattggcagctgttgccgcaatggatctggcatccatcagcgcaactgagctatactgtttttcattgggcttgcttccctcccggttagggaagttacgtgttgcgtgacgtatagaaaatgcctgattggcaggtgtgtctccataaccggagcaggaaccgcagatacacggtttcataatcaccccggaactcaaaagagtttcgactgcccccgcccgggtcagagccaggtttaccggcatgctggacggataggcagttacattaaatccgttatttccaagacttttcccttcaagtatggccgccatttccataaggttttcgtaaagtccgcctgcgcacccggcaacactgccctgatccgcgtagggcctgtggttctttaccttatctttaaaggaaaggactccaatcccaaacagctcgtctgcctccttttggacagagtcaaatatctcctcggcatgttcctggaactcatggatggtatatacattgctggggtggaacggcatggcaatcatggattgtgccttgtttaagtcaactgtaatgatggtatcatagtatgcggttccagaggctttcagcggcttaaaatacgctgaacgtccatggattccatagtaattttcagtcacctcatccgtttcccatatagaagacagacaagaactttcaaccatcatggtatcaatattgcaccggaaatccgcagaaagatttttcatgccaggaccggcgaattcaataatcttatttttaactactccatttttaaatgttgccccaataatagaaagagcaatatctaaggggcccactcctctgggcggcttcccggtgagatagcacaaaaccacctccggcgccggaatgtcatatgttctttccaacaactgtttaacaagctccggcccgccttcgccaaatcccattgttcccaacgcgccatatctggaatggctgtcagatcccagaatcatgtttccgcatttcaccatttcttctctgacatatgtatgcatgaccgccagattttcaggaacatagattcctccgtatttatgagccgctgtcagtccaaatacatggtcatcttcattgatggttcctcctaccgcacaaaggctattgtgacaattggtcattgcataaggaatgggaaatcgcttcattccgctgcttctggccgtctggataatgcccacataggtcaggtcctgggaaataagcgcgtcaaaataaatctgcatctgagccgggtccggggatatactgtgggaacaaagaatttgatacgcaatcgtattctcacgcccggcctcaggagagatttctccgcaactgcagacatttccgtcacgcaggaaacctccatttaaattaatgtgaatcatgtatgcttctcctttctggtatgtaaccatcctgctgttatatatagcaatttacatgccaatcatttttcttataaaagtcctttaatatctgcaataaccatcttttaatgtttgtcattttatctcttatgtcttataattagacatatactgtttctaatgtcctaaatcaaaaccatataacataatgaatttcgaggtaaaaccatgtatgaaaatgaactgctgattatttctgtttatccgggaatgatgaatgacatcaacgctgtatgcggctctctccagattaatccaaccattttagagtgggaaattgctgagaataccttaatcagccatctaagaaatatgttccgggaaactggcgtccctgatgctatcatcagcagaggcgcaaccgcaaatctgatagagcagaatataccggaagcagtctctgtgagagcagaaccaggagaccttgaacttctggaaaccttaaaagccgcaaaaaatcacggtccgcggattgggctgctgatgtttgaagattatcttaagagttataaccttcaggcagcaaaagaacttctgggaatcaacagtctgacgctgtaccccttccgttccagggaggatatcatccgcctggtccgtcagggaagcactgacggcatggatgtactggtaggcggaggaaccctggcataccggaccggcaattcatgcggaataaaagtattaccggtctactccgggcagcatgcgctgagaaacgcagttaaacaggccctgtccatcattgacgccagacagagggaaaaactgcagttaaaatgtttcaccgaggctgtctcctcaatcacggagggggttctctcaattgaagatggaaaatttatcgtagccaacaaagaaatgggaaatatattcaagacagatgaacaggccttgattggaagaaaggttgacaacacggacgacactctggttgccggatatatccggcactttctcacaaacagcagggagcgggaaaaagtcctgaaaatattgggtcaggactactacattaaaaaaagccattttgaagaaaagggtaaaaagagaattgttgcgatattccgcagagcccgtgacatccaggatcaggaacaaagggtacggacagagataaggaataccggcttctttgccagataccatttttctgatattattgcggaaagcgggattatgcggcagcttttgaaaaaggcagaaacctatgcagccacagatgccaatatattaatcggtggtgacagcggtaccggcaaggaattattggcacagagcatccataatgccagcagcagagcaaaagaaccttttgtagcggtcaactgcgctgcaatccctgcgacccttctggaaagcgaattattcggttatgaggagggtgccttttcaggcgccagcaaaggcggaaagcggggtctgttcgagcttgcccataagggaaccatttttctggatgaaatcaattccatgcctttagagctccaaagtgtactgttgcggacgctccaggaaaaagaaatccgcagaatcggttcccagcgtaatatttatattgatatacgggtcattgccgccagcaacagcgaccttatgaaaatgatccgggaggaaaaattccgtattgatttgtattacaggctgaacaccctccgcctgacccttccttctcttgacaagcgcagagaagacatccgccccctcgccatgtcatttcttaaccattacagccagaaatattccctgcctctgccagccctgtctgaagacaattaccgtcttttggaaaacaggaactggcaggggaatattcgtgaactcagaaatgtaatgcagcggtatgtcatactttcacatgaaggagaaaattcaatccagctatgttttgacgatgatatagcgacggaagcggcactggaaccacaggatgtaacaagctttggcacactggacgaaattgagaaagccgtgattcttaaacggctgaagcagaatcaaggcaatcgaaggaagaccgcccaggagttaggcatatcccggtccactctatggaaaaaacttgataaaatggagttagaccaggaaattacttcctattataactaatcatgctgcccgctaccagaattttacgttcatcgtccgtcatgtctccgattgagagcgtaagcatccggccctctgccggaatatatgcctgcaggctggtcgctccagatactgctgtatgatagtatgaatcatcaaatccatagtccacattccttataccatcttccatcccggccgtcaatacctccgctaccactgtcaacctgcctcctcagcggaccgtggcagcaatgcttcggacatccatcagggcggaagcacttaactgtccctggtccggcctggaagtttcccgactgtaataatttctgctcacatagcgtactgaaatagtgttattagatggtatattcgtactgccaaagcaggaaccacaaatacaggaatggatggttattccggtgcgaatcaactccctcagaacacactgcttttcggcttcttattctcgcacagactgtgaattgtaaatacattgctgggatggaacggaagtcatgctgagcttttctattcccggacccattatatccagaatcttattaactcaaactcctgtttatacagtaatctccattctatatcaacaaaaacagctggtgttccatgaatccggctcatgttatggcagtcctttgctttttggttgccgtggcatttgtggtatccgatttcaatggaatgtatttgtgccggtccccttacatgggtaaatccaccttcagttgagtagacttacatttcaagttcattgattcccataccctcttccgcctgattattgactgatgtgatgtttacatattcacctataatgtttaatgcatcttcataactattgcagcccccatttgtaatctgttcaaccatttgcttagctaatccatcctgcccctgttccttaagtgtccgggacgcaacagccattaaatcaaagatattgccattagccaagataaggggacaatccggtctttgtactgaatccgaaaaaccgcccaattgattctcgacataatctgacagccatgtactgccaaactgcgtacgtgtccgtattcgccatatagcaagtcttcctgcatctatgcacacaccatcaaaagtaaatagtaaatttgtaagtccttcgtgttcaaagactaatacctcatgaagctcctttctttgtagtaatctatttattgggaaatataaataagggctgcccacacgaacgtgacaccccttatcaatacaatctacatttatgcttccgttgctcctccacaactggatccctgaccagccgtacagccataacaatgattaccaaaacatattttcctagccatataaggctttccaaccaaatcaaagattgtctcacccgtcgaaacaggcagctcggatgcctggttgaaatcacaatcgtaaagtttgccgtcataccccaccgacacctggtaacggcacataagcccttccactgttgaccggttaaaagaactgcacagcttttgcatgtagctgttcaaattgcagctattctgtagaaagtgaaaaaatcgccctgtgggattattcgttattgtaaacagatgattaaatacaattccatagtcctccagaagctttactttgtattctttctccatagccccctgcgccggaggaaaaaatgctcctgcgggattatagaccatgttcaaaacgaggtcttcttcccggccatatcccaatgcatttaactcctggataaccttaaccgccttgtcgaaacttccatccccccttacacggtccatcaccttggcctggtaatagggaagagaacagaccacctctatcttataatctgcataaaacttcggtaaatgtttatatccttcttctgtcagtattacaagattactgcgtacaatgacatggctgcacgttttgcagacttctttcacaaaccactcaaattgaggattcatttccggcgctccgcctgtgatatctaccgtcttgactttttgttccccgcagacccgcagacaagcctccatcacatcacgctccatgatttccttacggtttgggcctgcttccacatggcaatgcttgcatgaaagattacataacttccccacattaatctggagcacgtccagattatcttctgtatactgtaaatgttcctcaatccggctttcaaacgctggtatgtattccatttgattcaattgttcgattgactcattcatctcttatagctccaatttctttataatattcttcatctgtacaccgtgtaccaatgacgcgcctccccggatggctgcggctacatgaactgcttccatcatctgttccgggcttacccccttatttaaacagtcattggcatatgcatcaatacaatatggacactgcacagtatgagctactgccaatgctatcaatgatttctccctggcggtaagagttccctcttcaaacactgaatgatagtaattaaaaaacttttctgccagttttggtgattcctcaccgatggaagcaaacttttccaaatcttccggattataatatgtgtccatctctattcctcctttgtccgtcgcatctatatcatcttctccagtatttctattatgtcccttacaacacatggacagaaatcgaacagcagcccttgctccaacacctgttccatatcatccgctttggaaatgtcgtgtcccagcagctctctgcacatgcaggattcatacttttcggcaaacaaacgcttaaactcagacgtcttttcacgcatgatttctttttgtttcaaatcgttattcatactatgtccgtacttgagaccgattaccatcagcgcaccagtcaccgctccgcatgtttcaccacactgcattccaccgccaaaacaggcagacatcctcctgagaaggctttcctccatctccaattcatctgcaaaccgacctgccactacctgtgaacagtcaattccctgcataaacagttcttttatttcctcttttgtcatctattctaccctttcccaagacctttaccagaatcttgtcatcatcctgtttatcatcgactttgcggtatccggttgttcattgcaatccaggatttctgtcaaaaggtgcgagacaccctgaccaccattacgtgtcaggttccctgcacatgatgcgcaatacgtatagacattctcatacccttcccctgtcacatggcatgccatacctttggcgagctccggctcctttcctcctgcgcaacctcccaaaccacagcactgtgttccttttataatatcgggttttttctgaaagaacggctccagccatgatacccactgttgttcttccctgtccggacatggcagaaacaaacttcccttcccatctactttctgtcctatttcgagttgtgataacttttcataaatactaaggacctgtatttccagcttatccttcaggaaataatagcaattgggacagagcatgacaatttcctgtatatctgcggcgcgaagtctttcattaagccgcctgattattttcccttcctgttctttcagtccaagttccgagaccggtttgccgcaacagtcaaacagcactcccatgtctgcctcattcttcagtattttgattaatttcctggtagtctccggataaaaagatggaaaattgcaccctggaaacagcacactcttatcctagctttcctgtccattgacatcctccactccctctggctggaccacatactttttcttgaagaacaatcccatgcccatgactattaccgccagtatgaccgcaatactgatataaagtaccctgttttccttatccgccaatcctgatgttcctatggtgtacatggctgtccccggcaacataaaaatcagtgagaatatagagtaggtgctgaacgggatatctgtgacaccatatgcaaaattctggagattataggggaacagcggtaccagcctggtaatcatgagcacaaacagttcattctttcctgcttcatcgaaaagccactttttaaggtaccggtttttcataactaccggtttaatactatccttcaggaagaagcgtcctgccagaaacgctgccatggctcctatcatggtagcaatggaacagcagattgttcccaataccggtccgaaaagcagtccggccaaaacagcaaaggtgactccaggaagagttaacgccacacatcccacaaccgtaatcacagtgtacaggaaaattgcattcaccagattttcttctgccatctgccttagaagattcaaacttcctgttccgcttaacacggccgaccaaccaaatatgtggttgcaggctaatacagctgctataattcctatgaatagaattagttttttatatgtatgaaacactgtcttcatttccatctcccattgacgcaaataagcgttggacttttttaaagcacaacgcttattgttttcctattacttatctgcccgtcttattttaaagatatcgctcaagccgataattaaaatacctgctgctgtaataatacataatatcagattaatttttgagaatggtattcttgtccgatggattccttcccgtaccagtgctgccggtaccaccttcatccgttcagccccatacatgacaaaccccatcaatgaacaaacaatcaaattgccggctgtaaagaggctattaaacacattttcccttttcctgaaaacaaaccatatcaccacggttgaaaggattaacaatcccccaaaaatatatccggtattcaccctcatctgcaaccattcactcttaaaacacagtatggcaatcgtcatggcccataaatagctattgtaaacaatcctaaaaagcttcatcatagcaatattttattttgccaggcggaaaacaacagttacctgggtaccatcctctggcagcacatccttatccccataaaacttggcaatatcattctgtgtggttcctgtaggccatgcagcatcgctcacaataccagttgcacagctgtccagacagagcacacatcctgtattattttctttggcgctctcaatatttcctccaaaccgtaaatccatggtatagtcttctgtacatttaatgatatcccggaatggaatttcatcctgtccatcccatttcacaaagacatcaagtttatccccttccacagattttccattatctggtcctgctttcatgtctgctgcagttaaattatcaccggctttggccccgatatcgagcaatgcctgataaaactccttctcatcagccagcccccgcaaaactgccttttctccgttggaaccacctttgtatacaataccatgtctggttggttccgtaaaatatgtaccattaacttcacacagcatgacaatttctttcttgtctttgtcaactgtcatggtttcctctgctgccgtctcctggaccttactctcgactgtattgctctttcctccgcaggctgccagtgaacatgccattgttgctgctgccataattactgctaatttcttcaatttcatcacgaaacctccatggttgattagatattatctgcaatatcagcagatttatctgaattccttttcttttgtttttccacatataactgcctgaacaaaacaataagtgctgacagcgcaaaaagcagaagaagcgctgtgacaaacatcttagcgccaccagtcagcataccgccaacatatgaatagataatggtggctggaagttgtccaataccagtggcaataaaaaagctgccaaaggacatggatgtcaagcccgctgcatagcttacgatatcaaaggaaatgaatggcagcagtcttgcaatgagtatgctgagacgcccatgtttttcaaaaaaatcatcaatctgcttcaaaccagtcctgctggtaagcttctctactgcatcacgccccaacagccttgcgatataaaaacatactgccgcccctgccatagcgctggaccacgataaaatggctcctttccaccatccaaacagatttgcattcgcaaatgtaagcagaaacgcaggtaacggcgctgctatggactgcaatatcatcagcaggaaggacaccagcgctgcgtaggcgccatacgattcgacaaaccgccgtaccacagtaaaatccccgctcgcaaacatcttaagaatgttattcattgtagcattaacaggcggtacaaaaaaatataccagtatacctaacacaattagagctatgacaacgaatttccctatctttctcgatttcttcttttccatattcgaccccctttcacaaatatttatcatattcattctaatcatctgtcgtgccattgaccaatggttcttttctatactgtaaggtcctggatagattaattctatacattctgcattacatatcccctcctgccattgttgataagttggatggattaaatatcaaatccgaattcacatcaaaaaaaattgatatatctcttgacaactcgttatttcaatcatataataatcatatcaattttttttgatgtgaggtggcgcatatggagcacaagtttacaaatgatgctagaattttcaaagcgctctgtgatgaaaagagacttacgattttagaacttttgcaaagcggggaaaaatgtgcttgtgtcttaattgataaaatggacatgggacaatccggactatcttaccacatgaaaattttatgtgaatccggcattgttacaagcaggcaggagggaaaatggactcactattcactcagtaaatccggtagcgaatatgcattaaagcgtttacgctgcttaactaccccaagagcagaggacgtgtctgaataaatggtcatcttcggatggcctttataagccccaatatatcaattttttttgatatgatattcacaatggaaacggaggtaatacatttggactcgatacaaacattttttctatttatccagaatcaaatattaggaatgaaatggttaaactccctaataaaaaatcttttaaccgctctcaacgtagatgtagacggccgattgggcggaagcattcaattttttatttacgacgtattgaaaataacaatcctcttatgctttttaatttttattatctcttatatacaaagttattttccgcctgagagaagtaagaaaatattgggacgctttcatggcgttggttcttatatcatttcagctctgttaggtactgtgaccccattttgttcctgttcatctatcccactctttattggattcacgagtgccggtttaccgctgggagtgactttctcgtttcttatttcctcgccaatggtggatttaggaagtcttgtcctgctaatgagcatatttggcgcaaaaattgcaattgcttatgtcatagtcggcctgatgatagcagtggccggaggcgctctgattgaaaagcttcacatggaaaaatatgttgaggaattcattcaatcagccaatcatattgatatggatgctcctactctaaccagaaaagaccggttctgttttgccagggaacaggtaacggaaacgtttaaaaaagtatttccttacattttagttggtgtcggtatcggtgcggcaatccataattggattcctgaaagctggattcaaacgatactcggaagcaataatccctttggtgttattcttgcaacgcttgtaggcattcccatgtatgctgatatctttggtaccattcccgttgcagaagctttgttagcaaaaggggctcaacttggcaccatacttgctttcatgatggctgtcacaaccttaagcctgccatcaatgattatgttaaagaaagctgtaaaacccaaactactgactctgttcatagtcatatgcactaccggtattattcttgttggatatctatttaatgtgtttcatgcattttttatataatcaatgaaaggggtaataaaatgcaaactaaaaaggcgacaaaactttatgtaataacaggtttcttgggggctggtaagactaccttgttgttaaagctgctagaacacctgaaagggagcagggttggtattatccaaaatgaatttggcaaattggggattgacggcgcaatactgaaaaatgatgatatccatatggttgaaatcaaccgtggttctattttctgttcctgtctgaaactctcctttgtcagcgccctcagtgaaatgacacaacatgattttgactacctgttcgtagaaagttcaggcctgggagatccatccaatgttgaagaaattcttggggccgttgatgctgtctccggtaaaagttatgatttctgtggtgttatctgcttagttgatgcagtaaattttataaatcaactgacagatttagagactgtatacagacagcttaagcattgtcatcttgccgtcattacaaaatctgatttggttgattcatcaaaaatggcagacctggaaaagaaaataagagaaatcaatccggtctgtaggttaaccacaagcatacaaggtaacatggattatagttttttagatgatgatttacttttatatcagtgggccgaaagtgaagaaaccaccaatacggaggaggcaaagccgaaaaccttattcatggaaatatacgatgctgtggataaaaatcaattagtgaaatttctaaatgaaatcattccaagcgtatatagaattaagggtttccttactgtcaatgggattggacggcagcaagttgatgtagtaggcaccaaaattgattttaaagaaagcaaggattccggtaatgctcaattagttttcatctcaaaaatagggccagcaatcattaaaaacatactttcagcgtggaatgacaatatagaagctgaaatgaaattaaaaaattagggaggcaaagatgaatattaaagtgataggtacgggttgtgaaaaatgcgatgcactatataaaaatgtccaaaccgcaatcaaagaattggatattgatgcggaaatcgaaaaggtggaagacctgatagatattgtaaaattgggagtaatgacttccccctcattaatggtggatggaaaactggttatttctggaagagtcgctaaaaaggaggaacttatcaaactcttccgataaacactcatggtgttatattctttagaacgaattggtatctcttacaaatatgttctaactatagctttatatttaaaaaagccatctcctacgtttaacctaaattgcgggaatggcttttatattatctgacacaaactattaattccagcccaccgattcatcagtgcatctaaatttttagttctggagcatctgattttgaaggtcaaaaacacagccttttttcggtatttcagggccattttcagcctcagaacgactatatcttatagttttatactaagttctcgcattattccacgagcgctgtcaatatcaccacctcaatattcttcctataaagaacaccaaaaccctccatcaatcttgacaatagtgttacactatggtacacactatacaaggaggtggacagtatggctgtttctaaaaataacgtgagagtacctataacaatccccaaggaattaaaacagcagttagacgaactggcaaaagaggacaagcgtaccttttccaacttatgcgctaaaattctgtctgactatgttgagcaaaaaaaggatggtgagtaatctttgagaatctatatatacagccgtaaatcggtatatacgggcaaaggggaaagcgtcgaaaaccagattgaaatgtgcagggagtatatttcagccaaaatccccgaatcagataaggcggaaatagtcgtttatgaagacgaaggcttttctgcaaaaaatacgaacagaccgcaatttcagcaaatgctccgtgatataaaactaaacaaaccagaatatgttgtttgttaccgccttgaccgtatcagccgtaatgtcagtgacttttcttctctgattgaagacttgaacagctataatatttcatttgtctgtatcaaggaagaattcgacacctcaaagcctatgggaaaggccatgatgtacatagcttcggttttcgcccaactggaaagagaaacgattgcagagcgtgtccgtgacaatatgctaatgctggcaaggaccggacgttggctgggcggcactacccctacaggatttacctctgaaaagatgcaggaaatcatcattgacggtaaaatcaagacttcctgcaagctaaaggacaatcctgaggagcttaaaaccatcgactgtattctggaaaagttcttagaactgcggagcatatccggcgtaagcaaatacttaatcaagcaaggaatcaaatcacgtacaggaaaaatgttctctctgttaggcattaaagaaatactgcaaaatccggtttactgtattgctgatgaagacgcatgggaatactttacggaacatcattcagacgtttgctttgaaaaaaccgagtgttccaataaatacggtctgctgacatacaataaacgtgattataggaagaaaaatgccccaagacagggtatggataaatggattgtagccatcggaaagcacaaggggcgtatttccggtaaaaagtgggtggccattcagaacatcttgaaagataacatccccacaggtacgaaacctgctgtcatgcataatgactattccctgctgtccggattaatcttctgcgacaagtgccagagccggatgtttgcaaagcagcgaagcggcaaaggcagcaaccgtgaactctacgactatatttgtaacaacaaactgcgtggaggtttaaaattatgtgactgtcaaaatctcaatggacagcaggcggacgatattgtttgtgaataccttatgcagtacacggatgaaaattccggcatctacaagcttctggaaaagctgaaacaggatttacagggccagacacaaaaaagtcccctatcagtcattgatgacaaaatcaccaaatgtaacagcgagatggacaacctaatcaacacactgtcgcacggaaacttaggcgcagctttcattgaacgtgtaaatgcaagaatcatggaactggacaaagaactggcttccatgaaagaagaaaaaaaacgtctgcaaaaggatgtcagcgtcataactgacaaggaaatccaagttgatatgctgtccacggcgttatccagcttcaaagacaatttccatacgctgacgattgaagaaaagcgtaccttaatcaagctgatggttaagaaaattgtctgggatggaaaagacctccatatttttatcgacggcgagtagggaactgtcagccctctactcgtcgtatggagcaaagttaccctttgggtggtggcgcatttcccaccctcattgcaattatctccatgttctttgtgggagtgtccggaggagcctttgactccatgctgtcagccctgcttctgaccctgtttattgttctgggtgtgtgcatgacttttgttgtctccaaaggactttccatgaccgtattaaagggaatcccctcctcctttaccctggagctgcctccctacaggcgtccccagattggcaaggtaattgtccgctccatctttgaccggacactgttcgtgctgggaagggctattgcggtggctgcccctgccggcctgttaatctgggtcatggcaaatgtgcaggtgggcggcattaccctgttagcccactgctccggtttcctggacccatttgcaaggcttctgggcatggacggcgtaattctcatggcattcatcctgggactgcctgccaatgaaattgtcattcccatcattatcatggcctatatggcccagggcagccttctggaatttgacagtctggcgcagctgcgggatttgctggtaaataacggctggacctggattaccgctgtcagtaccatgctcttctccctgatgcactggccctgcaccaccacgctccttaccatccgcaaggaatcaggcagcttcaaatggactgtcatttccttcctggtgcctacggtctgcggaatcgtactttgctttgcctttgcaagcgtggcccggatgtttgtatagcaagcgtggcccggatgtttgtataaaatgtatttccccgccgcaaaggacagctgagcaaaaaggatgggacagcagcacacatatgcctgtgctgcgtcccatcctcattattttttatcagttaaatatcatgccttacggattaatacattccgcccatatcaggtgctgcggggcctgccggagccggctccttaatattggcaacaacagtctctgttgtcagcagtgtggaggcaacgctggttgcgttctgaagagcgcttctggtaacctttacaggatccaggatgccagcttcaatcatatccacatactcttccttgtaagcgtcaaagccgtggcctacaggagactcttttactttatttacaacaacggagccttccagtcctgcgttggctacgatgtggaacagaggagcttccagagcctttaagataattctggcgcctgtcttctcgtcgccttccagtccgtcagcaacgctctttacttctcctgctgcgtgtacatatgcagagccgccgcctgcgatgatgccttcctcaacagctgcccttgtagcgttcagcgcatcttccatgcgaagctttgcttccttcatctctgtctcggtagcagcgccaacacggataacagctacgccgcctgccagcttggccagacgctcctgcagcttctccctgtcaaagtcagaggtggtttcctcaatctgcttgcgaatctgggatacccttgctgcaatggcatccttatcgcccatgccgtcaacaatgatggtgttctccttctgaaccttaacggattttgcacgtcctaactgctccatggttgcatccttcaaatccagacccagttcctcggagataaccgtaccgcctgtgaggatagcgatatcctgcagcatctcttttcttctgtcgccgtagccgggagccttaacagcaactacattgaatgtgcctctcagcttgtttacaatcagggtggtcagtgcttcgccttccacatcctcagcaatgatgagaagtcttgcgcccatcttaactacctgctctaacagcggaagtaaatcctggatattggaaatcttcttatcagtaatcagcacgtatgggtcgtctaaattagcttccatcttatccatatccgtgcacatataagcggacaggtaacctctgtcgaactgcataccttcaaccaggtcaagctctgtcttcatggtcttggattcttcaatggtgataacgccgtccttggaaaccttctccatagcgtctgctaccatggttcccacttcgtcatcagaagcagagatggcagctactcttgcaatctgctccttgccgttgattggcttgctcatcttcttgatggcttccacggctgcgtctgtagccttcttcattccctttctcaggatgattgggttggcgcctgctgccaggttcttcatgccttcgtttaccatggcctgggccagaacagttgctgtggtggtaccgtcgccggccacgtcgttggtcttggaagcaacttccttaatcagctgtgcgcccatattctcatatggatcctgcagctcgatttcctttgcaatggtaacgccgtcgtttgtaattaacggagcgccaaaggacttatccaggacaacgttgcgtcctttcggtccaagggtaacacgtactgtatctgctaactggttaacgcctgcttccagtgccttgcgggcctctacgccgtacttaatctgctttgccatctttcatcaacctccaatattttatgttctacaatgtaatgtcctgctgtattatttattattctacaactgccaggatatcgttctgctttacgataacgtacttctcatcctcaatctccacttctgtgcctgagtacttggagtagattaccttgtcgccggccttaacctgcatggttacttccttgccgtcaataactccgcctggtcccactgcgatgacctctgcctgctgcggcttctccttggctgcccccggaaggacgatgcctgattttgttgtctcttctgcaactaactgctttaacactaccttgtcaaacaatggtactaacttcatgattgaattcctccttacacgatattctgatttttctttcttgttttcttttccttacttctttcttttgctcacatgatatgttatatcaccagttattagcactgtcaagagttgagtgctaatttcttttaattttattgtttttttacaatttgctgtttctttttttttccattcgtattacaataataacaataaggcataatatgacccataggggagcttttatgcatcaccattacaagaaaggggtttttggcatggcaaagaaaggttggggtaaattcgtagcatttgcagcagtgaccggtgctgtggctgccggtgtttcctacgtacttcagtataagacataccacagggagctggaaaaggatttccgggaatttgaggatggcggcgaggacaggaccgatgaggacggcacagagcgcaccattgacacacgcagcctggaccgcaattacatctctctttcctccagcaaggacgaattcaaggttgctgccaaggatatggcccaggcaacaaagaacgtccttaaggatgccggaagcctgttatcagacactgcccatgaggcggtttccgctgccgtggacacggcccagattgcactccagaccgtgaagtccaagaaagcggatttcatggatgagcactccagggataaggatgatgattctgatttatttgaagatgagggatttctggatgacgactatgtggatgaggacgacctctatgattaccggcgcatggacggcagttcctcctatgattcaggagaccttacggaagatgattacgatgacagcagccaggaggaagcggaagcagtccgccccactgctatcatcgaggaagatacgctggattagaacaaaacatatcagccggacggaaacatgtacggcggtataaggcaatatacagcaaaaaagtcccggggacacaaaaccatcatgtctccgggacttttctgcccccattctattcttcccaggccagaaggttaatccataccggctggtcagccagattgccgtccatgatataggcatggctgtcatcctcctgggacatcagctggtattccccctgctcctctatataaatccagcggtggtccagctgcactgtgccgtcctttgtctccagcttccaggtggatgtctccccctcctggttcagggtggtataagtcacttccccctccatcctgtcaccggaaaaccttcctgtcttgcacacgtccctggcctccccttccgggccggtctcataatagcagtatccggtatggccctgcccctccatctttccgtccttccacagtccctgggagtaatcgtacctgggcgcatccagctcaaccacctggagggccgtacattccccttccggctttccattctggaaggtaccgtaatacagggtcttaggcatggtgagcaccagacccatgccttctatggacccgctgaatgactggccgtcatagagataccgtgttccgcccatagcctcataaaacaacgtcataagcgtctcttcctcacggtccatcacccgggccgcggtctccaaatcctgtgcctccaaggcttccatgatttccgccaggacctctttctgggactgcgttacatccggcagtatctctatttcctccccttttctccgggccgagtccgctcctccaccttcctgtacaccggctgctcccattgaagcgcctgccgcacctgaatcagcagcattccccatgagcctcccattttcattcgctgcaggtccttcctgaccatacatccagccatatccactgtccggcctgccataggcctggtcacagaccctgccatgggccctgtcatattggccccagcaggcgctgattcccagtaccgctgcaaaggcagccacagcagccaaatctgtccatctatctttcatggcataccattcccttcctgtaaacttgtctcttaataatccattcagctgcctaacatgtccaggcccttgccagcagttcagtgcccctgcggatttcttcctcgctgagactggcatatcccagcataacggttgagccgaaccggctctcctccggctgtatgaaacatcccgatattccgtataccttcacacccagggcagccgcccgggccaccagaccttcctccagctctccttttctgtgggtcagcagcacgtgaagccctgcatactcacccctgattaagaacctgtcctccagctccctgaggccagccatcagcgcatcgtgctttcccttgtacagcgccctcatccggtttaaatgccgctcataatatccctgggttataaactggtagagaatgttctggtcaatcctggatacggtggagaggtagtatccggcccgttcccggtatgcctccagcaaatgctccggcagcaccataaagcccacgcggatagccggggcaatggacttggaaaatgttcccatataaatcacacggccgccccggtccatgccctgcagcgcaggaataggctttcccttgtatctgaattcactgtcataatcatcctcaatcagataccggtccgcggcgctgtatgcccaggccagcagctcctgcctccgcttcacaggcatgacaattcccgtgggatactgatgggagggcatcacataggccacatccgctccgctccgggcaagccgttccacatccatgccataacggtccatatccaccggaaccacaggatatccctcccccttaagcaccctgtaggcctgcttataagtgggattttccatggcgattctccttccgtttcccaaaatctgggacagcagcatcagaagatattcgcttcctgcgccgatgagaatctgctccggcctgcagttcactcctctggcagagtgaaggtaatctcctatggcagtcctgagcgctctctccccctgggggtcccctgccgcaaacatttccttgttgtcatccaccagtgtgtttctgctgattttcctccatgtattgaaaggaaaactgtccaaatcaatacctctgggagaaaaatccacttcgtagcaatccttccctgtgtcgcccggctccacaaaagagcctccgcccttttgccgcacttccaccagctcttctatcttacacacaaaataacccttgcacggcagggcctctatatatccttctgacagcagctggtcataggccatctgggtggtgctgcggctcagcctcaggtttttggccagtatgcgggtggaaggcagccggcttccagcctccatctttccctggcggatttcattctttatgtactggtaaatctgttcataaagagggctgtctgtctgactgtcaaagggtaccatcagttccatgttccgctccttcccacccttaactggcattatcacttgtattcgaaataaacattttaatcataccagtttactggtaatgtgtcaatctatttttgcttttattcagtcaatttgcactattagtacagagaacagagataattttataatagtatactattttttctgatttgtacattgtaatcacaggtgtgtggaattataataaaagtaggaagagaaccgaaaaaacaattaggaaaggatggatgaacatgagcgaacagactctgaatatgttaaggaaactatctccaaaaaaggaacattcactggccttccgctgtttgataggggctgtggccattgtactgctgaccgtgttcatacacatcctggtcttcacagccatagagagaatcagtgcgggaagggatgttccggaatggtaccggctgcttgcaggcttatccgtggatgccctttatcccctgttcatagtatccttgatgtccatcatcaagcgggtattccgcataccggtgcaccgtctggaacgcaaggtcttcaagtttacatatctctgcctcggccttattgctgcatccagaatcagcatgtatgtggggctctatgtattcttcatggctttgtttgcagcaggcacagccatttatatcatcattggcatacgttttctctacgagctttttaaataccgcttcatatcctgccggtattattaggcatctgcatcaaaaggccagggaacttctttcatcaggttccccggcctttctttatcttgtttgtggttctatctgataactctatttcggaagtttgaatgagctcttcagggaaacaatccggttgaacaccggcttttccggcgtactgtctttgcagtccacgcagaaaaatccgttgcggacaaactgatagctgtcataggcctttccctctgccagagccggctccacatagcactccttcagtacaatcagggagttgggattcaggttcaggctgccgtcatcattcagcttgcccttctcctcatccacaatgttctcatacagacggcattccacctgccttgcagtgggaacagccacccagtggatggttccttttacctttcgtccttcaaagccggaaccgctctttgtctccgggtcataggtaccgtgaaccacggtgacattgccgtcagcgtccttttcacatcctgtgcacttcacgaaatatgcccccatcaggcggacctcattgccggggaacatacggaaatactttttcggaggctcttccatgaaatcctcgcgctcaatataaagctcccggcaaaatggcacctttctgtctcccagctccggattttccagattgttgggcacatccagcatctctgtttctccttcaggataattgtcaatgaccagcttcaccggattcaggatagccatcatacgcggcttcttaagctttaaatcctcgcggatgcagtattccagcatggcatagtccacggagctgttggccttggatacgcccaccatctccacgaacatcttaatggattccggggtatacccccttcttctcagcgctgcgatggacaccagacgggggtcatcccagccgtccacgatgttatcctccaccagctttttgatataacgcttgcctgttatgacattggtcaggtacagtttggcgaactcaatctggcggggtggattctcgaactcgcactcctttaccacccagtcatagagcggcctgtggtcctcaaactccagggtacagatggagtgggtgatatgttcaatggcatcctcaatgggatgagcgaaatcatacatgggatagatgcaccacttatctcccgtgttgtggtgggacatacgggcaacacggtagatgaccgggtccctcatgttgatattgggggaagccatgtcaatcttggccctgagcaccttctctccatcctggtactttccctccttcatctcctcgaacaatgcgagattctcctccacggaacggttcctgtaaggactctccttacccggtgtggtgaaatcgcctctgtattccctaatctggtccgctgtcaggtcacagacaaatgccttgcccttcttaatcaggaacacggcgcactggtacatccggtcaaaataattagacgcaaagaaaagcctgtcctcaaaatcagcgcccagccatttcacgtcatccatgatggactccacgaattcagtcttctcttttgtcgggtttgtatcgtcaaaacgcaggttgaacttgccgccgtatttctgtgccaggccgtagttcagtaagatggacttggcatgtccgatatgcaaataaccgtttggctccggtgggaaacgggtctggacatggtcataaacaccctctgccaggtccttgtcaatctcctgttcaatgaaattcctggagattacctccttttcctcagtttccattacggtatccttgtctgccataattgttcctccgttacgttgctattgtgataaatataattattaatcatatcacaattatgacatatgggaaagggaaaaatacattttacagtggaaatcttattccatgtctgctatactacctgtctttcggagttgaactaaaaaaatggtgctaagccatgggttagaaccctgactgtaaatatatgatgtgttgaattgcccctaaagaattatggtgttaaagcccaaagacgggttttgtgaacatttatcacccgtttattgcccgtataccggctgtttccggcatagaataactggcttctgttttttaaatactgctatatcaattagaaatcatacaaataccccctcacctctgaatgttgtaaacaacatcatattatagcggtgaattgttgatttaatcattcctgtctattataataataaagaattctgctataaaacagggacatatatggacgaactggcagtgcgggaatgggtggaaaaagaatggaaaaggacaaagcaataagttccagatttaatttagtaggtaaatataagtttaaaagtgtatttgtaaggattctaatcttccttctgctctattcatcactgcttttggcggtgctctacacatacaaccgttatattatgcgtaagaatgtggaacagagattgggaatcaggacctttgcagtgttggaaaagacccaggagagtatagacagggagcttcataatctgtccaaccagatagtacagctgtcaaaggacgaatatataagagctgtgatgacagctcctaacatcaagaattcagaacgcaattacaatattgtgtaccagctgcaatctgtgaaactggttaatgacttggtaagcggtgcctttttataccttcccagcgatgataccttctacagcagtgagggggtagcggtgaaggcagaacaatacaagggaacaggacaggtaaaccagcttttggaattttgcagaaatgcagatgcacaggtgggggaacagcagtttgtatccataggaaagacgcagtatctgctgctgtatgcccctgtcttttacgatagaatactgggggtgctggcttttcagattgactcaaattatctgaattccatcatagaaggtaagggggaaaccgggaagggaaataccatatggacttacgataaggagggatacccggtatttccttcccagatagggtatccggagaaacttacgccggaggcagtaacggacatgccggttacctctggttttccgctaggggagaaaggcggatactataaactggtatccgcgcaaaacggctggcagtatatattagggactgatgcagacctatttcggatggaggtatctgctattgacggcgggcttttgctcattgtgctgggacttgcatttttctgtatcctgttttccgtttatttggccagaagtgtgtatcttcctattcacaaactgataggaattgcagatcaggtggcaaaaagcggggatgagacggtttcaaagaatgaactggaacttctggaaaaaagcgtcagctatactgtgatgcgcaatcaggagatgagacattttttgcagaatataaaacctgccatgatatcggatacattccgtaatctgctgctgggtcatgagattgacaatgaaacgctggacgcaacctttacagcactgggaacagaattcagcaccagactgaattatacgctggtaatcatttcactggtctcagaggatagggagttctctctgctggagtgcaatatccttctgcatcggctggaacaggaaattatccgatacgcagaaggacgctatatatgcagttttgtccatatgctggaaaacagtcatatgattgttgttatgggttttccaaagacggtgtcggcaaagcagattctgagctggaaggaggaacaggaacagcagatacaggatatatgcagcgattatcctgtccagcttctgacgggaagttccagatatatcatgggtatcactgagctttataagaatttctcgctgatatgccaggacttaaaatataaaatttaccttcagaatcacagggaggaggaagctcacactccgctcatcgaaccggacaggcagctgataagcaatacattttcaactataaaagagaaaattgataacggcgaggaggaggaagcaagaaatctggttaaaaagacagctatggaattgcttaagcataaaaatacatctgatgagttgaaggagtttgcagcttattggtgggaggctgtgatgaaggagctgataccgcttgatgtatttgacagggaagaactctacaatcagagaacgcagctttttgcatctctgggtgacagggaaaggttccagtcacagctggaacgctttaacagcctggcaatagatggaatcaaatccagctcccgtaagttaaaacgcagatatgtggagagagcccgtcaatatattgaggaacactacagtgagtcgaatctttccctttcagccatatctgagtttttgggaatcagccaaagttatatgagcactcagtttaagaaagagacagggacaaattttatcgagtacctgaaccgttaccgcattgagagaagcaaactgctgctgcagatgacggaaatgaccatcgaagaagtgggatttaaaaccggattttccagcgccaagaattttatacgggtatttaaaaaatatgaagagatatctccgggaacgttcagggaacagtaaataaggagatggagagagggcattgccgcatagagggatgaaaaattccggggcaatgtcttttttattattatagatatccagggtattatacatccttatatagttggcaagagacaattttttagattctattaccattttttacgaaacaggagtagatgaataaaatttgagaacattatgtgaaaaaaggggcatttattttcttaacgaaatctttatataatggacctatgccacacaagctggcagcgaaacctaaaaacaagtattttacagaagggggttacaatcaaatgaaaaaaagagtggtatctacaattttaacagcagcacttatcggcagtatgctggcaggatgcggttcatctgcaccggataagacaacagcggcgccggccggaaacggcgaaagctcagcagaggcatctgcagagacagcagcaccggcgggacaggtgctggagctgagccttgcggacgcacagccggatggatgcgcctgtaatctttccatgaaagccatggtggaggagattggggagaaatccggcggcagcattaaggttacctactatccgaacagccagctgggcaatgaaagagacctggcggagggcgtaatggccggtaccgtggatatggcatgggtatcctgtgctgtcatgcagaactttgatgacagttttgcaatattttcacttccttttatatttaaggattatgaccatgtacatgcctacgggaacagcgatttaggaagacaggtatttgggaagctggagaactccagtaagattaaagtgctgggactgttcgaccaggggttccgttggatttggactaccaataaagaggtaaagacactgaatgatttatctggccttaagatacgtacgcctgagtcagatgtatacacccagacatttacactgttgggaaccaatcccacgcccatggcatttggggatttgttcaccgcattgcagaccggggttgtggagggatatgaggtaaacccggagtctacatggagcaatggaacctatgaggctattaaatacggtgcaaaaagcaatcacatttttgccggctctgttctttttatttcccagaatgcttatgaccgtctcagcgaagaccagaagaagatactggaggaagctgcggcaaatgcagttgtatataacaatcaggtggcacaggaaagtgaagctgagtatgagaaaaagctggtggaagcaggattgtccatcaacagcctggatgacggcgaacaggagaagtttgctgctgctgtccagccattgtatgaaaagtactacgacatggtgggcggcaaggagtatgtggaccaggtcagcagcatggaatattagttttaatgaaatccgcttccttcataccgatgaaggaaagcggattctacatatagaaggaggttgacaatgaatcggtttttcagaatattcgatatgacagtaaatctgcttatgatagcctgctccgttggatttgtaggactggcatttgtacaggtcatctgccggtttgtattaaactcgtccctcacctggtcagaggagctttgccggtatctctttgttgagatggtgttcctgggggcaggcgtatgcgtgctggagaaaaaacatgcagcagttgatattgtcattaaaatactgcctaaaaaggtacagaagtattaccaggcagttctggacggtatcgtggtggtgaccggtatactgattacatatttcggatgtaagtttgcctgtggagcagtggggcagacctcaccggctctcaggcttccctaccagtatatttatgccggtattgtcctgggcggagctgtactggctattgacgggttgagaaatctgtacaccacacttaccaaccatattacctaccacagttatattaatccggagctgaatgaaaaaggggaggtagagtgatgctgagtattttgatgattacatttcttgcacttttgattttaggatgccctattgctgtgggaatgtgcttttccagctttgtggccctgtttgcaggaaataccacggtgcctcttacggtggtgccccaaagaatgttcgtaaccattgattccttcagcatgatggcgattcctttgtttattttggcaggggagttgatgaacagtgccggaattaccaggagaattgttaacttctgcagtgctctggtggggcatatcaggggaggactggcccatgtgaacatccttgcatctatgctgtttgcaggaatctccggagcagctgcggcagacagtgcttcccttggctccatgctgattcctgctatgatagaagacggctatgatgcggacttttccgtggcggtaacagctacatcctccaccataggacctattattccgccaagtatcatgatgattatctatggttccatggcaggcgtgtcaatcggtgccctgttcatgggcggtgttataccgggaatcctgattggcattacattgatgggagttgcctatgtcatatcctgcaagagagggtataaggcggaggctaaaaaatctttgcgggagattgcagtggctttccggcagtcgctggtggctcttgtcatgccagtcattgtgctgggaggtatcttgtttggcgtatttacaaccacggaggcaggatgcatagcggtggtgtatgcgctgattgccggattcctgatgaaagaacttcatctaaaagacctgttccgcatattcctcagcgctgccctgacaacagccagcaccatgtttgttctggcgtcagcccaggccctgggatggatacttgccagggctcagtttccgcagatggttgtaaatgcccttttgggagtatccggcaacggcactgtcatattccttctcatattgctgttcctgttcttcctgggattctttatggacggaacagctgccatgattatcctgattcctgtatttttgcctgtaattgcacagtatggctggcatccggtacagtttgcagattgtattatcatgatgctgcttgtgggagctgtgacgccgccggttggggttctgctgttcatatgctgcggaattgcaaaaatatccattgcccaggcagccagggcagtatggccctttgtaatgggagagatagcagttatcctgctgtgtgtctttattccacagcttataaccttcctgcctaacatgatgtacggagtgtgattcgagtgaaggaaaagatatgtttgaaaggtattacctggaaccatcccagaggatatgaatccattggggcggtgtcaaaagcattttcaaggaactgcacagatgtgaagttacactgggatgtacgttcattaaaggactttggagactacccggtaactcttctggcagagaattatgatttaattatgctggaccatcctcatattggcagtgcagtggaaggcggcgctctgattcccctgaatcagtggctggaccaggcatttttagaagaccaggagaaaaattcggtaggacgcagctttgagagctatcagatgaatggctgccagtgggcgctggccgtggatgcggccgcccaaatcagcgcttacaggccggaccttatggcagggattttgccgcccaggaattgggatgaggttaaaaatctggcaaaggacaggaaaagggctggctgggtaggattccccctgtgccagacagacgtgtactgcagctttctcaccatatgcgccaatataaggggtgacggggtaatatgcagggaatcaggtgtggaataccaggctgcgctgcaggcagtggaacttctccgggaattatcggaactggtttacccggcttccctggatatgaatcccatacaaatgctggagcatatggctctcactgatgaagtctgctatgtaccgctgctttttggatattccaactatgcacggacgccccctttcgggagaaagctgatacggtttaccaatatcccatcctttacacaaataccttcgggagcgctcctggggggagtgggactggcagtgtcttccggttgtaaaaataaaagaattgccgcagattttgtcaggtttgctgctcaggatgatatccagaggggaatttactatgagaatgcaggtcagccgggttatctgggagcctggacggatgaggcggttaacagagactgccacggttttttcctggatacgctggatactctcagactcagctatctccgcccgagatatggggggtataaccggtttcaggagatggcaggtcttattttgaatcagggtttaaaggacaggcagaagccgggggagatagtgagctgtcttcaggcattatttgaaaaactgaaaaagcagaggtgataagtgcatggatatgccgttggaaggactgaaggttattgatctttcccaccatatggccgggcccgtggcaagccagaggttgggagacatgggggcggatgtgataaaggtagagcccctgggttatggggagtggaccaggatacgtccaatcggaaacggctgggtaagtgagtatatgaatacttcctttattagcgctaaccgtaataaacgaagccttaccctgaaccttaaatccgctgaaggaaaacaaattcttctggggatgattggtaaggctgatatatttataagcaacttccggccgtctgtccacaaacgtctgggtttggattatgataccctaaaattagaaaatagaagactggtttattgttctgttaccggttatggtcaggatgggccttataaggacagaccgggtcaggatttgctgatacagggcctctcgggtgttacctggaatgcaggacgggacggggaacctcccattcctttggggacttttgtggcggatgccatggcagggcagaatgcagtggaaggcatactggctgctctttactccagggagaaaacaggaaagggccagatggtgtctgtggatttgctgtccagccttatagaggtacagactcaggaatatactacctatctgaactcaggccagcttccggagcggacaaaggaactcctggcgcatcccttgattaacagtccttatgggatacacaggacaaaggacagctatctggcactggcaatggctccgtttgacaagcttgcaaaggctttggggtgtccggagctggacagatttaagacatgggaggacggacaactgcacagagatgagattttccggctggcggcagaggtcttaaaaaccaggaccacagaggaatggatacaggtccttcaggaaaaggacttgtggtgcggggaggtgctgacgtatccgcaggttgtggagaatccgcaggtgaggcacatggaggtgttccgcaccatggaaagtgaggattacggagaggtacaggtggtgagcaatccaatccgtttcagcgatacgccggtgacataccgtattgctccccctgttctgggaaaacacaatcatgagatattaagggaatatggatatacggaacaggagatagaggaatttttaaaaaagaaagtgattcaggatgaaaatcctgagacattcaggatataggaaagcgaggcataaaatggaaactattacatacgagaaacagggacatgtggcgaccatccgttttaacagaccggagaaaatgaatgccataacaccggatatgatggtgcagctgtatcagtgcgtggaggaaatcaacgctgatatggatatccgttctgtggttgtgaccggaggggacaaggttttttgttcgggcagcgatatcaagaagctggtaacgtatgatactccctgggattttcacaaccgccaaaaggattatcccacctccatccgtctgattcgaaagcctgtcatagccatggtaaacggctattgcctgggcggcggtctggaaatggctatcagcgcagatatgcgctatgcgtcagagtccgcaagattcggagcccctgagattaatcatggctggattgggggaggaggcgcaagccagattcttccgcggttggtgggaccggggctggcagcggaaatgctcatatcgggtaagacctacacagccagtgaggctaaggatatgggactggtggaccgtctctatgggacaccccaggaactggagacagctacttacgatatggcaggactgattgcatctaaggcacccattgcagcccaggtaataaaaaaagcggtcagggtatcacagaatataggactggacgcgggactggactatgagaatgaattagtttacataacctttagcaccgaggataaggaggaggggcagagggcatttattgaaaagagagaaccggtatttaaaggctgttaacaggaggggaaaagcatgagccagttgttggaaggagtcaggattttagattttacacaatacaaggcaggtcccatgggaacgcagattttaggagatatgggggcggatattattaaggtagagcggagcaaagggggggatttggagcgcagttttgccacattcgggaagttcacccaggagggggacagtcctttctttctggccatgaaccgcaataaacggagtctgggacttaacctaaaaacgcctgaggcgaaggaggttatctataagttggcaaaggaggcagatgtggtggtgcagaatttccgtcctggggttctggaacggctgggatacggatatgaggattttaagaagataaatccgggcatcatctactgttccaatagtggctacgggctaaccggtccttatgtgaccaggccggggcaggacctgctggcccagtccatgtccggactggtgatgatgaacggtaaggaggattctcctacggcagtggctacctcggtggccgatgccgccacagccctgtatctctgtattgccatattgggagccctatatcacaaaaaggcaacgggagaggggcaggaggtagatgtggatttactcagcagtaccatcgcattccagcaggaggaaatttgtgcttatatgaatctgaatcccagaccggatttcagaagaagcaggacaggactggctgcaccgtggaatggagcgccttacggcatttacaggacatcggatgataaatatattgcattgggggtggttcctatggaaaagctgtcaaaacttttgaatgcaccggaactggccaggtttacagatttggaagaggcatttaacagcagggatgacatacggcttgtggtggaagaaaagataaaacagaatacacaggattactgggtggaatacatgctctcctatgatgtgtggtgtgcccaggtgaatacatttgaggaaatgctcagggacccacaggtcatccataaccggaacatacgtaagatgcagcatccgtccttgggagaaatcggtgtggtggctacaccaatccggtataccaaaacacctattaagtatgatatggcgccgccgctggtaggacagcactcggcggagatactgagagaactgggttatggggaagacgaggcagaggatatactgagcaggcagtaaggctgagtaagaaggggcgtatcgcggctgccgccgctcagatttgcagcggtttaaggccgcagcccctcaaaccccggaagattccgcaccaccccaaacacaagcagcaccccaaccatcacataaaacacacaggtctgcacctgcgtggggcgggtgtttccggtccttacataccgcacagccatccggagagccatgaccagtcccggaggaagcaggagaaagacggcagcatttgccttaaaagcagatgcaaagtccagactgagaatggacaggcacatacggcttacgccgcagccgggacagtacagtccggtgaccgtatggaacaggcagggaatcaggggatgtccggccagaatacagataaatgcataaaacaggccggctcccaggagcccgcctgtttttatgcataatgtccgaagacgtttacgcattagggagatacttgttcagctcattctgaagcagggcgtaagccacgatgcccagtccgaacaggctgagaagcagatagaccaccggtgcgcttccccttggctcaccatgctggtcatggagtatctcaactgcattgcccatctggtacatccagtaaagggcgtaaatcccacaggtaatcagtgagaacaggaaaaccagtccaccgcttgtaccctgcctgccggaaagcgcattggtatcgtcgttcaatacaatcatccaatagatgccgtaaatcccgcaggtaaccaggctcagcaagatgcatactacaatgttgcgctgtttcatacgtatatcctccttggtgtggtatagtcaggtaatacagcttagattctatcataggcatggttctttatcaacaaaaagcgttacaatgttcatctttttgccttctttttacgcttgttatgccttgggctccatgggaaattgctggcacattgctggcaaaatctcatttttatggacgaatgaggccggatatgttatactaactaagataggcgtattccgatttctggatacgaatggaggcagactatgaaagataaaggaaggacgcgggggattttcaaggtctacctgcagtggccgctctttttgtcggtccttttaatcgtactgactgctgtggtggcagcggtatccataaaagccggcattatagtatcggtctttaccattgtctatatagggattgccctttggctgtatttttcaagaaaaagaggcatacttgccgggcttattgcattttcttccgcttatgaccagagcaggcagaacctgctggaagagatgctgatgccctatgcggtggcagacggcgccggacatctgttgtggatgaaccgggagtttgcggcaatcctggaagaagacaagaattcatataagaatattacggccatgtttcctgagattacaaaggaaatgctggctaccggcggggaggttgtgagtcttcacagttccctgggagataggaagttccggattgatttaaagcaggtcatggtggacagcctggatgcggcagtgactgcgggagggctggaaggccagggctcatccgtcacggccatctatctgctggatgagactcagacgcttaagtacatgcagcagattaacgaccagaagctggtggcgggactgatttacctggataactatgacgaggctctggaaagcgtggaggaagtccggcgctcccttctgaccgccctcatagaccgtaagataagcaaatatatttccggcatgaacggcattgtaaagaagattgagaaggataagtatttctttgccatcaagcagcagtacatggccaggatacaggaggaacgtttttccatcctggaggatgtaaagacagtgaacataggcaacgacatgtccgtgaccttaagtatcggtatcggcatgaacggcgacagctacagccagaattatgaatatgccaggacttccattgacatggccctgggacggggcggtgaccaggcggtggtcaaggactcggataagattcagtattacggcggcaaggcccagcagatggagaagaccaccagggtgaaggccagggtaaaggcccatgccctcagggagctgatggagaacaaggaccggctccttattatgggacaccgtctggcggacattgattcctttggtgcagcggtgggtatataccgcattgccatgtccatgaacaagaaggccaatattgtggtcaatgaagtgacctcgtcagtgcgccctatgatggagcgctttatgggaaatgcagaatatcctgaggacatgctgctcacaggtcccagggcagctgagctggtggaccagggaaccatgctggtcatcgtggatgtgaaccggcccagcattacggatgaaccggcccttctggagatggtgaagaccattgtggtcttagaccatcacaggaccagcagtgaaatcatagataacgcagtgctttcctatgtagagccatatgcctcgtctacctgcgaaatggtggctgaggtattgcaatatattgcggacggtattaaaatcaaatctgctgaggcagacgccatgtatgccggtattgtcattgacacccagaactttaccaatcagaccggtgtcaggacatttgaggcagcggcatttctgaggagaagcggcgctgacataaccagggtgcgcaagcttttcagggagaatatgaaggattatcaggcaaaggcggacgcagtcagaaaggccgaggtgtttatggatgctttcgccatcagcgaatgctcagccgaaggactggagagtcccaccattatcggggcccaggcagccaacgagcttctggaaatccgcggtatgaaggcttcggtagtgcttacggattataacggaaccatatatttcagcgccaggtccattgacgaggtcaatgtccaggtcatgatggagaagctgggaggcggtggacaccgcaccatagcaggcgcccagatgaagggcgtgaccgtggaagaggcaaaggagcggctgaaggacgttatccgccagatgctggaggaaggcgaggtatcctgataagggatgcggacagacacagaaacagaaaggaagtatgagacatgcaggtagtattactggaagacgtaaagtcattaggaaaaaaaggtcagattgtgaatgtgaatgacggctatgccaggaacttcatactgcccaagaagcttggggcggaagctaattccaagaatctgaatgatttaaagcttaagaaggcaaacgatgacaggattgcggcagagcagctggcagcagccagggagctgggagcaaagctggacgcttcctccgtgacactgaccatcaaggcaggagagggcggaagggcctttggctccgtatcctccaaggaaatcggcaaagccattggggaccagctgggaattgacattgacaagaaaaagattgtgctgaatgaccccatcaagtccattggcagctttgaggtaccgattaagcttcataaggatgtgacggccagattggctgtcaaggtagtggaagcataaaatcatagcgcagacagaggacccgcctaatcaggcgggtctcatagattcagatacaggagacgagaatatggaagaagccctgattaagcgggtgctgccccatagtctggaggcggaacagtcggtcattggttccatgcttatggacagggaggcagtgattgccgcatcggagattgttacgggaagtgatttttaccagcagcagtacggcattatgttcgacgccatggtggagctgtttaatgaaggcaagcccgtggacctggtaacactccaggaccgtctgaaggaaaaggatgtgcctcccgaggtgagcagcctggattttgtccgggatatcgtgaccatggtgcctacatctgccaacgtaaggtcctatgccaccattgtaagcgagaaggcagtgctgcgcaggctgattaagaccacggaggagattgccaatacctgttacgcgggaaaggagcccctggagaacatactggcagacacggagaaatctgtctttaacctgctgcagaaccgggggggacaggattttgtgcccatcaaacaggtagccatcaacgtgctggagaagattgaagacgcctataagaaccagggaaccgttacaggtattccgtccggcttcattgatttggattataagctttccggtttccagccttcggatttcattctgatagcagcccgcccttccatgggcaagacggcctttgttttgaacgtggtggattttgtggcggtccgcaagagcctgccctgcatggtgttcagcctggagatgtccaaggagcagctggtgaaccgtatgctttccatggagtccaatgtggattcccagaagctgaggaccggctccctgacggattctgactgggacgcagtggtggagggcattggcgttataggaaattccaagctgataatcgatgacaccccgggtatttccatatcagaacttcgctccaagtgcaggaagatgaagctggagtacgggctcagcgttgtaatcatcgactacctgcagctcatgagcggcagcaagaagggcggaggcgacaaccgccagcaggagatttccgatatctcccgttccctgaaggcccttgccagggaactccatgccccggtcattgccctgtcccagctctcacgggcctgtgagaccaggcaggaccacaggcccatgctttccgaccttcgtgagtccggtgccattgagcaggatgccgatgtggttatgttcctgtaccgtgacgattattataataaggatacggagcatcccaacgaggcggaagtaatcatagccaaacagcgtaacggccccatcggaaccgttacattgatatggaagccggagtacaccaagttcgtcaacgctgccagacctcagggcggcggacaggattagagggtatttgaacataaaattttcaccgcctgtcataatatccattctcaatgcatacactaatactaaggcaggaaatgcctgttaacttgtgaaggagagaatggctatggatgaagtacattatctgatatcggacgcgtccaaaaaggtcgatgtggaggcccatgtattaaggtactgggaagaggagctggaacttgatattccccgtaacgagatggggcaccggtactatacggatttacatatccgcctgttcaagcaggtcaagaacctgaaggagaaggggtatcagctgaaggcaatcaagcatgcgctgaaccaggtcctgaaaaaggacggcaaggcccagggcgagctgtccgatgaaatcctggagcgcgacatgaatgcggctcttaaggaatttaaggaggaggacagcggaacctccctcagtacggtgaagggcgacggcgtgtccgtggtcgccatggaagaaaagatggaacagttccagcagattatgaacctgattatcggacgtgccctggaagtgaacaatgagaagctgagccaggatatcagctgtctggtcaatgagaagatgggcaaggaactggaattcctgttccaggcttcggaccagaaggaggaggaacgcttccgccagctggacgagacattgagaagctaccagaaaggcggacaggcagaggcggcagcggccaaggttcccttttttaagcggcgcagattcgggcggagcggaaaaaagctcagggacggaaagtaaatgcagatacagcaggagaaggcgtctgcaccaaggggtgggtaccgtggtgcaggcgcctttttctgctgttttgcctttttttataaactgggaagggttattttatagtactttcaattttcttacgaccttaatttttgtatcgctattccttaagaaatgtgttagaatgaatttgatttgagctttttgacataagaagaagcaggaaggatatgttcttcatgaattcaaaatacagaaaatatgttacatatacagcagccgtgggtgtgctgaccctcagcgttatactggggggctgcgccaaggaatcgtcatcagaggtgggggatgccaccccttcggaggtcaatattatacaggccgtacctgagaccattgcccagctgggcctggacggacaggtgctgccgggactgaatgacattgacctgccggatgcggagccggcacctgagtacctgaggattggggtgcgccatgaaatcatcaagagactgcagcagcgcctgatggacctgggatttatggacaatgatgagcctacggactatttcggtgagatgacccagcaggcggtaaagcatttccagagacagaacgagctgcctacggacggtatcgtgggcaatgtgacctgggatgccatcatgtccccggacgccaagtactatgcggtgtccaagggaacccagggcgatgacatcgaacgtatccagcaccgcctctatgagctgggatacctggcaacggctgatttggttacaggcaacttcggcgactccacagaggcagccgtgttaaagctccaggaggtcaacggactggagcaggacggaaaggtgggccagaggaccatcaaccttctgtacagtgatgagattaaacctaacttcctctcttacggcgagaagagcgatgtggtcctggcctgccaggagcgccttaaggagctggggtatctgaccaccactccggacggggcttacggtgaggacacggttgtggctgtcaagcagttccaggccaggaacgaccaggtggtggacggctatctgggaccatccaccaggattgcgttaaacagccctgacgccagggccaacggcctgatgctgggcgagcgcggcgatgcggtcaccaaggtgcagcagcttcttaacaagcatggatatcttgtttccggcaatgtgaccggttattacggcgaggccacggagaatgcagtcagaaacttccagtcccgcaacggactgacatcagacggcctggtgggcctacagaccatggctaagctgaccagcgataatgtaaggcggccggcagcaaattccagcggttccggcaccaccgcaaggcctaataattccggaaacagcggaaacgccggaaacaacggcggttccggcaatgcgggcaagccttccggcaataccacgccgcctgtgagcataccggcaagcggaggcgcatccgcccttatatccgttgcctcatcgaaactggggtcgccgtatgtatggggagctaagggacccaatgcgtttgactgttccggctttgtatactggtgtctcaaccaggtgggcgtgaaccagagctacctgacttcttccggctggaggaatgtgggccgatacacaaagattacaaactttaacgacatccaggccggcgatattgtggtggtaaggggccatgtaggtattgcggcaggagggggcactgtcattgacgcttcttccagtaacggacgggtggtgcacagaagcctgagccagtggtgggccaacaacttcatctgtgcatggaggattttctaacaaacataatggcagtggaatataaaaaggagggcgtttggtgatgcagaccatactggtatgtgatgatgacaagcagattgtggaggccattgatatctatctgacaggggagggatttaaggtaatcaaagcctatgacggctatgaggcactggagtatctggataataatgaagtggatttactcattgtggatgtgatgatgccgggactggacggcatccgcaccaccttgaaggtcagggagaacagcagtatccccattatcattctctccgcaaagtccgaggatgcggataagattctgggacttaatatcggggctgacgattatatcacaaagccctttaatcccctggagctggtggccagggtcaagtcccagctgcgccgttatacccagcttgggaacctgaaccagcaggcggacggacagatttataagtgcggcggacttcagattaatgatgacaataaagaggtaaccgtggacggcgatgccatcaagctgacgcccattgagtataatatcctgctgctgctggtgaagaatgccggcaaggtgttctccattgatgagatttatgagcagatatggaatgaggaggccattggggcggataataccgtggcagtacacatccgccatatccgtgagaagatagagattaacccgagggagccaaagtacctgaaggtggtatggggtgtaggctataagatcgaaaagcagtaggtggttgtatgacagatgagaagaggaaattcagacggagaaaacagatactgaccctgttccacattatctttgtggccatgtccgtgtttggaatcagcgccatgtaccttaattccaattacggaaaaggtgtaaagtggatatacgaggatgcatatgaggattctccccagtttgacaagcagctgacagaggatatcgaccgcatatttacctatgtgggttataaggatatgttcgagaccaacggtaagctggatatgcataaggtcatcgtaagggtcagcaatggccctggggagcaggggacggagtggaccctggaccggattgtgcgctatatcaagaccaggggttattatctggatgagaatttccaattggccggatcgcccatttccatggatgatgacgaggaagagataaccgttgacttccagagctataacccggattttgtggatgcggatgcgggcgaggcgccccggatgaccatggaggatttagccctggacatactggtccatctgagtgaatattataccatatattataattacatagaaaacgacacgaacctgaacttccgtatcgagtacaagagtgataagggtgatatcaaggtgtccaccaatgtgccggataagaccatggaggagatagtgggtacgggaaagtatctctacgttccgggaaataccatccgcatggataccaatatggccacggttcctgccaatgcagccacactcctggagatatggaatccctataagaacgataagaactatatggtcctgtccgtggatacaagctatcccaacacggatgcatactccatagaggccaaggcatataaagaggccagaaacgagttcatcatgggcatgggcagcgttatactgggcagcctgggatgtgtggtcacactggctatgctgatgcttatgtcaggccataccacggacggaagcacggagatacgcctgttccccattgatgagatacacacggagctctgtctgattttgtgggccgctgcaacagcggtgttcatccatataggaagatatgtgggaatccgcctgttcagcctgtttgctcccaatgaacaatggaattactggaataagatgattaaactggtcattgtgtacgggagcgttgtattgtgcggttttgatttgctgcgcaggtataaggccaggaccttgtggagcaacagccttgcaaaaagggcgctggaggcatccagggactatgtgggaagggtcagctatgcagtggggaccgggttctgctacctgctgtttctgggatttaacgctggcatgctgtggggattgattttcctctttttctataagggcgataaactgagctaccagattatgttttacgtatttgtggttctgtatctgggtttggatgggtggatataccacctgctgtttaagaagtcagtgcagagggatgttctggacatggcggtcagcagcatctcccagggggataccagctatcagattgatactgcccgtctgtccggcaaggaacggcagatggcagagcatctcaacaatatcagcagcggtttggattcagcaatccaggagcaggttaagagcgagcggctgaaggcgagcctgataaccaatgtgtcccatgacattaagactcctctcacatccatcatcaattacgtggacctgctgaagcgggagaaaatacaggaccccaagattgcggcctacctggaagtgctggaccagaagtcccagcggttaaagaccctgacagaggacctggtggaggcatccaaggccagctcaggcaatatgaagctggatatatcggatattgacctggtggagctggtgcagcagaccaatggtgaatttgaagagcggtttgccctacgcaggctggagctggtttccaacatacctgatgaggtgcttatcatccaggccgacggacgccgcctgtggcgcgtcctggaaaacctctataccaatgcggtgaaatatgccatggaacacagccgggtctatgtggatgtgctggacgaggacggcaaggccatatttaccattaagaatgtttctgaatcatcgctgaacatcagcccggatgagctgaccgagcgttttgtcagaggggatgtgtccagagccacggagggaagcggcctgggattgtccatatccaaggatttgactcagcttcagggcggcgaattccaggtcatcatagacggggacctgtttaaggccgtggtgtcattcccggtcaagagggctgaatacaagtcggagaagccgtccgtggacacagaggacatgtcccaggagtttgattttgaagaggaagtataatttgaatgaagaattctgataaatatttcacgaagaaattgtaaaatatttgaaaatattgcagaataaaccgtgtttgttggttattatgaccatgatgattttaagaaaaaggacgccggaagatatcttccggcgcctcttttttccatgtgcaggcggattttactgataatcaaatacgttaatccagctttccagcagttccttttcctcgggacgtttgtaagccagctgggaagctgccacgatgggaagccagccctgtacataacgcttttctgtgcccgttttttcacagaacaggtccatgtacatatcagctatcttcttatccttcaggctcaggagcagatacgttctggccacatcggcacttgcgttgccctgggaagcatgtacccagtcaaccagataccacttgccgtcgtcgcctacaatgatgttggatgggcagaaatcgccgtggcacagcttggtgtgctttggcatgccgtccagccttgtaagcagctcgtagcgcaggttttcatccagctgttcttcggatttaagggcgcggatggtcttttccttcagcttgtttaacagcgggcaggcctgtgcaaaaatcagcaggtgtaaatcaaccatctgctccaggtactcccctgtcttgtcaggattttcttccatcagctgctgaagggttttgccctccacaaattccctggtaatagaccatttgccatcgattacagatacccccagaaccttaggaacattcagggcctcaatggtttccacacgtgcgttgcacagggcttcattcagaacctcggcttttgggaagccttcgcagaattccttgatggcagtgtttccgtcacggtaaacggattttgtttcgctactggaaattaattgttttgccataattatactctccttccacacattataaacggtgctgcgacaggtaatccatcgcactgcctttattctactacaacatgactgaaaagtacatacccaatttgataaatttttaacgtacttttaggccctaaaaagataatatttcttaaaaacggaagatggcagtaccgtatgcaggaagaggataggagaaggagtagggctgtccgtcgcattcgctttttgaggatgagaagcagggggcttccgctgccttgtaagcgccgtggttgtccagaagcagggtatacctgccgcgcttgggaacacccacccggtaatccggtctttccaccggcgtaaagctgataatgaacagcaggtttttctttcctgtctcatccctgcggataaagctgaaaatgctcctgtcgccgtcattggcattaatccactggaagccgttccagtcattgtcctggcggtaaagggagggataccttttgtacagatggagcaggtcctttacatagctctgaagctccctgtggtcatcctcatccgtgagataccagtccagggaaaccttttcatcccattcatgaagctggccgaaatcctgtcccatgaacaggagcttctttcccggatggcccatcataaaggtgtagccggccttcaggttggagaacttgtccctgccaaggccgggcatcttattaatcatggagcatttcagatggaccacttcatcatgggaaaggaccaggatatagttttcgctggtaaaataagtgagtccgaaggtcatgcggtggtggttatatttgcggaaatatgggtccagcttcatgtattccaggaaatcgtgcatccatcccatgttccacttgaaggtaaagcccagtccgtcctgttcgggatgctccgttacctttggccatgcagtggattcctcggcaatgacaagggcaccgtggttgcggccctggaccactgtgttcaggtgcttaaagaattcaatggcttccaggttctggttgcctccgtttttgttgggaacccactggccttcctggcgtccgtaatccagatacagcatggatgcaactgcatccaccctgagtccgtccacatggtactgttccacccagtaaagcgcattgctgatgaggaaatccttcacctcattcttaccgtaatcaaacaccttggtgccccagtccgggtgctccccctttctgggatccgcatactcaaagagtggctcgccgtcaaaatcagccaggccatgggcatccttggggaagtgggccggaacccagtccagaatgacgcctatgccgtttttatgcaggtagtttacaaaatacatgaattcagccggcgtgccatagcgggaagtgggggcaaagtatcctgtcacctgatatccccaggagccgtcaaatggatgctctgcaatccccatcagctccacatgggtataccccatctcctttacataggctgccagctcatgggctgcctctgtatatgtataatatccgtccttttccggcctgtcccgcttgcgccaggaacccaggtgcacctcatagatgctcatgggcagcttctgcacatcggcctgggtccgcttctcaatccatgcgctgtccgtccaggaaaagccctggatatcagctgtgacagaggctgtgccgggacggtattccgcactgaaggcaaaggggtccgccttatagagaatcttgccggactgggtggtgatagcaaatttgtaaagctctcccagcttcatgcccggactgaaaatctcccagatgccggattcggagattcgctccatggcattggcctccggattccagttgttgaagtcaccaaccagatggacctcctttgcatgaggggcccagacagcgaagtagatgccctcctttcccttgtatgtcctgggatgtgctcctaatttctgataaatatcgtaatgtgtgccggctccgaacagatagcagtccaaatcagatataaaacctgtggaagaagcctttttctttgaagatgctgcagtgcgttttttagctaccatatcagttctctcccttgactttcaggacagctccccagttgccctttaattttatgtggaccttcccatcagaaatggggaggaggtctccgggttccagaagattgactgcttcaccggcctgaatcggaacagggataaccagttcggccgggtcatcgtcattgtttaccgctgcaatgatgacagaatcctcaccatgcctggcaaatgcatactggcggttggtcagcagcagttcctggtagcggcctgtgtgcagcgcctcctgctggtcgtgtatctgtcccagctgtgcaatcaggtccgtaagctcacagtgcagctcaccttcctggtccatggagacagcaggacgcagcgcttcatcgctggtgttggtgcgttttccttcaataccccattcgccgccgtaatagatggatggaatgccgggcagtgtaaagaggcacaggtatatggggaacaggtgctccttcagttttagtttagtggcaatcctgtcctcgtcatgattgtccacaaaggtgtagagctggcgtccaatggcctccagccttcttacgttgtgggcaatctcaaagaagttgtggtcattaaagccggagtaaaggcttttgtgcagttcataattggtgacggagtgaagcatctcactgcatgcccaccggctgtaatccccatgaatcacctcgcccatgagccagaaatcttctttcatggtttctgtctggctgcgcatttccttcatgaagttaaagtccagcacattggcacagtccaggcgtattccgtcaatgtcaaatgtatcaatccagaaccggatgacatcaaagagataggaccttacatccgggttgaagaggttcaggcagggcagctcaaaatgtccctgccaggcttcgtatccaaaggaatcgccgcaggggctctgccagtcaaagttaacacccttgtaccagtccctgtaaggggaatcccagcgtttttcctgtatatccttaaaggcgaaaaattcgcgtcccgtgtgattgaacacgccgtccacaaccactttgacgcctgcctggtggcattggtccacaaatttccggaaggaatcattatctcccagacgccggtccaccagtttataatccctggtatcgtatccatggctggtggattcaaaaagcgggcctatgtagatggcgttgcagcccagggaccggatatggggtatccacttgtctaattcttcaaaacggttggttacttcggttacatcattgtgtttgggggctcccgtcattcccaggggatacatgtgataaaacacaccccgctcataccaggtactcatgttgttttcctcgcaatctttatgtagtcatattttacagcgcccggagggggatagtacggtgagtactaatcctcctggcttttaaattttcgcagtaggaactggtagcgcagctgtgccgcgttcagttcgtagatatagcagtctatcagggtggggtccacggcctgctcaaagtggttcctggcggcatcgatggcgcatttggtgcgctcgatttccacgcgcaggcggatgagctcaggtctgggacgccgcgccctggtcacggtggccctggcggcagctgtctccctgactgctttcatgatgtcaaacatatgcttcatctcccagatattgatagaaatagtatatctggaaaacggcatcttatgcatgtgcggtcaatggaattcaattttaatacaggctgtcagtacaggaattcctccagtctgtagcccagctccatcagccgccggttggattccctgagggtaaggtagtaaaaattggccgttccttcctgacgtacacctacaatgcccgcatcctttaatattttgagatgatgggaaatggccgggcgggaaagactggtccgcctggtgatttcatttacattgaggccgtagtgctcgaactggatgggacccgggttctgcctgctgtcaagggcttcctctgtcagtacctctatgatggacagacgcatctcatcgcccagggcaatgaacagcggcatacaggcatgaaaacgtttctgtaattcctgggcagttgtcatctgccgtttcctcctttggtttaaaaatttgaaccaaatttattttaccatgtataggatggaaggtcaaggaaatcgggggtgaaatacataaaatccactaaaatccacccttgacatttgctggaaaatccttcataatggaacaacattcaacacagtctatttcatgacagtcttatttatttcaatggttttatttacgtcagcagtatttgcattgcctggttcaggcagaaatttcctcagaaagacaaccggttaaagagagaggggggagtgtattcagtttacattgttttatgtcctgtacactgtatggtattctggcctattgcgcccttatggatgtcaggcattacaggatacctaacagggccctggcggccgcggccgcggcagggctggcagcttcagcaggagccggtatatacggggcgggaggtaccggcttatgggcgggagataccggcttatgggcggggagtaccggactttggacagcagcggtgatgattgcagctttcatggtacggacaatgttggctgcggcagccggtttcccgtttttcctgtttcgcatggtgggagccggggatattaagttcatggctgttatggctggctgttttggcctggaacggggattttggtccatggcaattggtttgtgtctgggagctattctggctcttggaaggatgctgcgggatggcggcatctgtcggagattcttgtatttgactgcctatatcaggcgtttgattcagagtaaagaaattgaggcgtattactgtccggagcgggatgggtatcagtgcgtcattccattgggagcatgcttttttgcagggatgctgattactgtgttgtggaagggatgagtgtggggtgaacaggtgcgtatgcaccggacggaaatgaggtgagaaacaaatatatggtaaagattctggcagtctatgacgccgaccccgcctttggggaacggcttgcagattatgtgaaccagaaagaaaagattccgtttacggccatggcattttccagcctggacaggctcagggaatatggggaggaacatcccatagaaatattgctggtagacgagtgttccagagctttggtgggtgatgtgaaggcagagcaggtcatggtgctgtgcgacggggagctggtggaaggaatggaggcatttccctctatctacaagtaccagtccggggactgtattatgcgggaggtgctggcctcctactgcagccgtccggtggagcccacgctggcccttctgggggccagggccctggtcatgggggtatattcccctgtgaaccggtgctttaagtcctccctggccctgacaatagggcaggtggcggcaaagaaggaggcggtgctgtatctgaacctggaggattattctggtttttccaggctgataaacagcgggtacaaggccggtttatcggatgtgctgtatttgtaccggcagggaggatataactggatgaggttaaagtccatgattagcaattggggaaatatggattacataccgccggtgcggtatgcggaggacttaagccaggtgtcgccggaggatatggcgcagctcatagacaggattgcaagagaaagcggttatgacaggctggtagtggacgtgggccagatgggaaggggagccctgcctgttctctccatgtgtgatgtggtctatatgccggtcagggaggactgcatctcggccgccaagctagaggagtttgaggagtacctggaggaggcggacgatacaggagtcagggacaggattcagaagctgaagctgcccaggcatacgggaatcggaaagcgggacggctatctggagcagctgatatggggggagatgggagattatgtgaggcagcttttaaatgggagacagccggaacagtaagagatggaaaaggagcagtgaggaggagacgcaggccatggaagaggggaagcgtacgggaaagagagaccgtgaaggcgtccggtgggtcattagggagcgtatcatggaagaattgcaggaaaggcaccatatggatgatggggaactgctggaaatgattgacagggctatagaggacacgggacaggaaatgtttctgccgttaaaagaacggctctggctgaggggcagcctctttgacagcttccgccgcctggatatcctgcaggaactgattgacgacagctcggtatcggaaatcatggtaaatggggcgggaaagatatttatggagaaaaacggaaggatggaattgtggaacaggaattttgaaaaaccggaacaactggaggatatcatacagcagattgtaagccgggtcaaccgtgtggtgaatgtatcgtcgcccatggtggatgccaggctggaggacggttccagggttcacgtggtgcttcctccggttgccctggatggtccggttgtgaccataaggaaattcccggacccgattaccatggaaaagctcattcgcttcggagccataagcgcggaggcagcgggttttctggaacagctggtggaggatgggtgcaacatgttcatcagcggaggaaccaattccgggaaaaccacgtttttaaatgcattgtcttccttcataccctccggcgagcgggtgattaccattgaagattctgctgaactgcagattacacaggttcctaatctggtgcgtctggagacaaggaacgccaatacggagggggaaggggaaattaccatgagccagctgattagggcagccctgcgcatgaatcccaaccgcattgtggtaggtgaggtaaggggaagagaggccctggacatgctgcaggccatgaacacaggccatcccggcagcctttccacggggcatgggaacagcccgcgggatatgataagcaggctggaaaccatggtgctgatggcggcggaccttccgctggcagccatcagaaaccagattgtgtcagcgctggacatcatggttcatctgggacggctgaaagatgggaagagaagggttatatccattatgagaataggaggtttgcagaatggagaggtggaactggaaccattgtttgaatacgacgggaaggaggaccggcttcgtcagaaacaggcctgggcttagaaggaacctggtcaggcaggatattgccaggagtaaaccggaaaagagggcgcccagagcccggcctcctgacagggaggactatggtgtataccggcttacggccagagagtggctggtatacggggcctggggagtggggacctgcgggctggtaagctatgtattttaccgcagtgcggtgatgtttctgtttctgatgccttttggggcctgttatcctttataccggagaaaggatttgaagaaggagagggccaggcgtctggaactgcagttcaaagagggaatacaggtgctttcgtcctttctcagtgcagggtattcattggaaaatggacttgtattgagcataaaggagctggaagtgctgtatggaagaagggagatgattacagaggagttccggcttttgtctgacggaatccggatgaaccgtccggcagaagagctgttcatggattttggccatcgcagcggactggaggatgtggacaattttgcccaggttctttctgcggcgaaacgaagcggaggcgagctggtggaaatcatccgccagacagcgggaatcatccgggataaggtacaggtaaaggaggaaatacacaccatgctggcctccagggtatttgaacagaaaatcatgaatctgataccgtttctgattgtgctctacattgaccttacatcaccgggatatttcagtgtgatgtacagaacctggatgggacggggagtgatgactatgtgtctggctgcttatgcgggtgcgctggtcctggccggaaagatactggatattgaggtgtgaagggcagatgaggcggaggataaaaatgagaaaacggcctgggacaaagctttatgcctggattgggaaaaaacagatgatatgcctggcagccggcctgtttatgggagtggccgcccacctgtggcagcgggcggacagtgcgcttctggaaggcagcattctgcccaggggaagctacggacagggggacaggacatacagcctgatggtggagggccttggggagaaggatatgcccgttgaaatggtcctgtcggaacgggtatataccaaacaggaggcacgtaatgcgtacgaggctgtgatggaccagctgccgcagcttattctgggaaataatcccacccttgaggatgtaagacagaacctgaacctgcttacatatctggaaagctacggaataagactccggtgggaatcggatgaaccggagctgctggattcctttggcgaattgcatgtaaaggagataatgcagaggggaattggggagcagggaatccggattaacctgcgtgtgcgcatgacagagggaaactggccggaagaatacggactgtccgtatgcgtgaagccgccgctgcttacagaggaggaacagaaggagacggcatttgccgagtttttgagacaggaggatgaaaaacagtcctccgccgcttatatgaagcttccgtcagaatatatgggaaggagcctgaaatacagtctgagggaagaaccggttttccttcatgtgatgggattgggggcagccggagccatcttattcttcttcagggaccgggcagagcagcggaacagggaagaggcgagaaagcgccagctggcgctggattatccggaggtattgtccaggctgactatttttcttggggcaggcatgagcatccggacggcctgggataagattgcactggaatataacatgatggcagagcagggaaggcgcaggaaacggcatgtatatgaagaaatgtatgaaaccagctgccagatgaaggggggagtgccggagggaaaggcgtttgaggaatttggacggcgctgcgcaattcagtcttatatgaagttaggcagtctgttggagcagaaccgcaaaaacggttcgaagaatctcaggaatcttctgcgtgcggagacagcagatgcatttgaacagagaaagcaccaggccagacgcctgggggaggaagcgggaacaaaactgctgcttccgctgttcatactcctgtcagtggtcatggttatgatagctgtcccggcgctgatggaattcaaataaaatacaaggaggaaggcgatggagttaggaaaggaattaagggaattctgggaggatgagcatggggtgggggtgattgagctggtgctggtattggtgggaatatttaccccctaattcacgctatatattatgtagatacagtggaaatagtggaaatagagaaacagtataaacaggagtgtgtatgaagtacagtgatgattgcaaggtgtatagaatcagatattataatgtatggttctatttatttgcgaaaacagagatggatgagtataagattaatatattaggcgagcgtataggtatgggagattcgatgatgatgaaggatattcattgctggtgcaccagacaaaatataaggtatagaacaaagttcaagtatcgaaaagattatccaatattagccaacatctggaatctgtactcgtattgtcgctttaggtgtgatcttaaaaggtaagtctggacaaccttgtggataaatcataaggagaaaaagatttaaggggataactggtatttatatatttagaagcagatgagccaatcatgttttatttactagaacatggttggctttttggcgttaaaaagttcaaagaaaaggggagtgtggtaattgaagaaaatggatgaaaaaaagctaaaagaagattcgggctttccttatggatggaataagggagatacctgtgtgatgatcacaaacaaaacaaaaaaaagtacctgcgaatatacggtagagagttatgacgggaggtattttggagtacgaagtcatactggactttatcatcgagtttcaccgtggagaatgtttcgtacaagggaggaggcggttgaaacattattagaatcaaaagaacaaggatatggaggaatgacattagggtagaagaaattgagatattgaggaggtaggagacaatgattcgatttatgagtgatacacgttatgctgggctggaaaaggaaatgctttatctttcacatcactccgatgtgtaaattatttttctttttaatttagtaaaaaagcagactcttggatatcctcttgtccaaaagtctgctctcttactttatgtaaaattatctattttctttcaacctctgattttcctcttctagtaattctatctgcagctctagctctttaattcgtctcttgtataaaatcatttgtcttttcagctgtttattaacttcctcagttgctctatcaaaaattgcctttttaggattataacattccccctgcttcaactgtgcatcttctaccatttgtttggcctgtaaatttctataaaaataacttctatcaactcctgcatattttgccaatgtagtaatcgagatcctctcctttcttcggagcatcgcatcaatctctctctgaataatttctaaattctctttttcttgttgtttcttgagacctacgattttatcatacttcatttaacatcactcacacctttctgttgccttcgcaaagtatctaactctgattccagcttttgattttccgctttcaattttataatttcaattctcatagctaacaacttttccttatactcatcaaggagttccgcttcgtctatgttcattttatagctttgattttgaatatcaacagctttatgtacttcttctttgattttttcatttctgtagaaaaacgagttagataatcctgttcttttgcataatccggaaactgtaatcctttcaccctcattacgcattctttgaatttcttccattgctagttttactttttgcctacttttctcctggctcatttcgatgattttatttgctttcatctttaatcacaacctttatagttttttcaacaacgcaatctcctttcgatccaaccgtttcttcaatgtgtccacctctttttgaagtatactgcacttttggagaagctgctcattttcaacctttaacctttgattctctgactgacagctgttaaaatccttcttcaattcctgaaaattataacccacaacatttgtttcttcagatggctgctgtacatctatccgccgtggcagtttgacagcttcctcaagtctctgacggacttgcatattcttataaaaaaatcctcttgataaacctgtccaacgaaccaattctgttacagatatcggcatccctctggcactcatatcatcgattgcccgaatcgccttttttattttctgctcactctcagctttgttaacagctatcatcttatcatatttcatacccatcccactcctttaccacatccattaaaatcatatcgattttctctctgactgccctcgtttcatccgccattatcttgttcccaatctttcgataatgatgtacactttgtaatgttttatgccccaaaagccttgcgatcatccagtcgtcgatatgcatttctgtcagctttttcccataacaatgtcggaatgtatgtgttccaaaattcagcagttctccattctcatcccgaatatcatttttcctaatcatttgcatgactcgattttggagcatgctatactgaaatggtttcgatggatcatctttttttacaaaaatatattttgtctttccataatgttcctcggtataatcaattgactttataataagctgtgctatttcatcactaattgctttttcaaatgtaattgattttacctgctcgattcgtataaaatatcgattttctcttatactcaaacagtctgtttttagtgtaagcgtatccgaaattcgtgttcccagcagctgatgaaggattaacgccctcgctatttgttcatccatctgaaaaatgttttcattcagcttctttatggtttcgtccgaataaaacttaaatagatatcttggcgtgctgggaaaatctgtacttataaataggtttttgatatcctgcctatcataatgatttcccacatcttcaactacccttcgtagaccatataaatcagagcgataatttttcctttcctttgcctctgtctgaagatagatcaaatagctttccataatatcccgtgtcaaatctagtaatgatataatcttaggataccttaattccagatatctacaaaatcttttagtcgctaccacctcagccataatacttcctattgccatatatttcaaatgcataaaaattactgttttaacttcttttcggattgttatttgactaattcctttaaaatttatagtctttacattctttatcgggttgctgcggagaggaaattcaaacttgtccaattcccacacatctctctcctgttctaagcaccccccatctttctgagaatacctcagaattttcttcatatgctttattatgccaggtgtttctgttgctacaatttcataaacgcttcgatacttcttacttgtaagggcatatcccttttccatcatccaactctttagctgcaaaataatcttattctcgtcttcatatctcaggattttaatattcttttctataagaaaattccggatattattaaaatataatatttcagatgccaaactacttggagcaagtttctttcccctttcccagacaaaatcttctaggagctttcttactgcttctgacggaagtccctccaagtcgaagtaacggtctttccgaaccctcattctctttttttgttcttcagtcgcatttttatagcagtctaattcatagatatgtatcttattttccagttttttcaccccgtttctttggaataattccagttgcaagaagattttctgcctgattgaaatattccttattcgcctgttcgatccgtttaggcatgtagtctatatactgctttgtcatattttcattgttatgccctaaataatcccgaatcgtctgaatggacactccttcatcatagaaactacttgccaatgtatgcctgtaatcatgcgtcttgaatgtttcgcccgaaatatgtattccatacttcttacaatttgctttgaagcccttaacaaatgtaccagtcctatatgccccgccatcctttgatttaaacaggaaatcggtaggtttaatatgatgcttatttatataaattttcataatttgataaagcaccaatgaaattggtatcattttttccgctttcattttgatttgataaaccttaatccatgcatcttccccatcccaataatatgcacctccttttaatgtacacacttcactgatccgtaatcctgttgcccataaatttagaaaaataagtctttgtacctctggaaaaaacttcagcctttttaatatttccatatactcatcttcctgaacacttcgatcatggtgatatggaaaaactttctggatgtaataattcggatcaaaaattattctcttgatatgtcctttagcatttaagtacacaaaaaatctgtgaatatcaaatatctgtctatttactgtttctgctttaatttcctcttcctgcagaagtttgaaatactctgctatctgttcttccgtaatttcacatatggattcaaatgtgttaaagtaaactagaaattttttaatataacacaattgatttcgtatatttccaagtgctaaatcaccgatacctacttgatatttcatatactcttgcagcaattctctgtttctctcattcgtcacttcgtaaaaactgagtcgctgcacaggattgcttggatttacacgctctggtgcaaaattgaatctttccatataccagacatttgcataccagtgaatttcttttccactcataaatagtattttgcggctgttatccacaatctgcatactattcttcacatttgcaactttcctggctacaattgtttccaatttctttatttgctccagctcaagccgctcgatatcttcaattccttcctctacgcaaaactcatacatccaccttaaaggaagaagatagcgcactcttcgatccttgctgtcttttatatttcttaaggcatagcacaaaatctgaaaaatttgtttttttaaagtttccggcgccttttgactaaaatcccataccagttcgcttttatcttggatataatcaaaatctgatgctatgtcctgatccggtatatagggaagaaaaatcacttgcccttcatacttgagccgctctttatttcttccagaaagggtttccatttcttttcggatatcaaactgcttgatccgatccaatgtcttcaaatattcaaggcctttcgaggaagtttttgtcctgcgcagctcactttcatacagttctctgattctataatcaatttcctttacatgatgaattctctgtcttatcaagaaattcctgacatttcctttcaagcgttcttgcactgtattgcactgctcaatttcattcaacaactctttatactcttcttggatgagagtcttcttcaaatttcgcaggaacccagttcgctcaaatacctgtttctttgtaaagttccctgtttcacgcaaaaagattttataattacggaaatcctgttcttctataaggaaaacatcatatatccctacaccttttaggtaggactctgcacactcccagtatgtactcggtacatttatatctgttatcaactggttgtgaagataatccgctttatcctgtgattccgtattcaataatcttaatgcagtcacatacttctcctccttccctaaagtaatttgtcaatttcataaatggactgatgttttctataaaattcatcactgacatccatcaactcctgatccgatatatttaaatatctcattgttgtttctatatttcgatgcccaagcgcttgactgataagttccaacttccatccagccttccggcgagcatttgcaaaataatgccgcagcatatgtggtgttactttaatcccagtcttcttctgcagccgttccatcaatgcatagacgcctgagtcctgcatcggttttcctgcataatctcccgaaatgttaataatcaagtattcctgctggaaaataaggtctttatattcctctatataaaactgcagaatttcaaaggtggcatcgctgatttttgcctttctgtattctgcattcttagctctggctccattttcattatcttctctaaaattgacatacagcaagtgtctctcataatcaatgtctgtcgcataccggactcccaaaagttccccgatgcgaaatcccgtttctgctaataataaaagcaggatttgatcgcgacaattggcacatgcctttaataaaatcacgatcttatcctgctctatggtcttccctatatgtcctttttcctgtagatatccatgaaatgtattccgatataatgttctttttactcccactgaattatgtacaataattctcatatcagagaggactttcaattgctttgtagattcatcctgctgtccagaaaatctataaaatcggaacacctcttttaaatatgcattacaggtctcattatatggtttctttttataactatctccactatgcaatcctgcctgtaaccatatcaaatagtctgtaaagtgttcctgctgcttatcatatggcatctcccatacatcatctaactgaatgccagtctcatctatataattcagatagtatgaaatggctcctgcacttcttctgatagtgttaggtgacaattttgatctttttttatgcattagatacttggagggcagtaacactatgtcttggctctcctgttcacgaatgaaataatatttttcgtgattatctatctggaaatccacaatataccttgccatattactttactcctttcctctaacgctatacacagtataccgtgttactcttctcatagctatcacacaatgtaacaatctttccttttcaaacgaagcattatcaataaacaacgtcaatcgatttgataactccctgctattccaaatgcaatacctgcagttaacaaaaatccaataattccaactgccgcaacaatcaatatcccaatcatgatcgttctacctcctcaacaatctctataacatctgacattctgccatcgtaaccgcttcatcttccatagcaaaatattcatctgccacattgcgttccaccgccaaaatctctccagcctccttctctcccagctggatcggcgccaaatactcaataattctcccacataatttctggtccggacaaacatccagcatccccatacaggtattcacaatcaggcgatccaacacatcggtaatcactatttttttagcatcatatcctctcgcaccgataaaatttgccaagttctccggggtcagtgccaacatatattcttttctggctcccccaccatatggatactcataggcatatcccatcgtttctgtgtccatgatccgttctaccatattcttttcttctgctctcataaaatcttctctcctattttttcaactgccaaactcaattttcccttccaatggcgaatatgcatcgacatcatagctttcctgaaggatctgaaatcttgcgagctgcatggatgatctggacagcctgccacggtttacaatcaaaagaacatctacctgttctttctgaaccgcttctataaaatgacgaaatccatttcgattccaaagcggagttgtccccacatcactggaacttccaaccagttcaaatcccatctgctctccataatcaatcagctgtttaaactgactttttaatgcaccatttctatcttccggtgcatcaatcgcacaatagatccacgcacgttttccctgacccattcctgcctcctgctccttttccaaacaccctttatgttcttctctgtactgttacaccaaaactcacaagaattgcctcatctactttacgcatcatggctccactcagacttcctacataccctcttaatcttatccggtcaatcgtccttacctgctccaataaaataacagaatcattatggaggcctcttacatgatttcccaattcgatatgtgtaggtatccagtgcttattaggccgacttgtaattgctgccacaatgacagttggactgtaacaattaccaacatcattctgaataatcaaaaccggccggattcccccctgttcagagcctattaccggcatcagatctgcataatatatatctcctttttttatcgtaacacttcccctccttccatctactctggactacgaatgttcctactctttatgaaaagtctctatctctatgtaattctgccgtcatatggcaaatgccctttttccagcttacgctgatgacctcgcctgccaaaagttcatcagctcggattccctttcccagctccttcttggctgcttctttctgcccttccaaaagtatggattttacctggtcagaattcagaaataaatatcctttcgatgtcataaaatgaaaattgctgtcagaatataattccataaattctttgacacgcatatacatcttcctccttatcattttgtgatttagaacacaaggatagcggcagccttatccagctgatccatctttccttttccgctggataaatataaagctgccgccatagtttctgttaaaaatcacttgttcttcattttcaaaagttcctattcgacacaacttcccggaaccagatatcggaaatactgatattcctgttacaaccgatatctttgggcggcaacactgaccagccatggcttaaggctgtcatgggattgttcccctccgagggtctctccgagccgccctcattgcgtgttcccgttttgcggggctgtgactggacggaagtatcattataggctgttcaggtcattgcaggcagtctgccaaaactgctttaaggacaaatttttttcgctctgcacctttgatgtcatcttattgacagacactctgactatctgcaggtggtcgtggcggattttcctttgtgcttttccttttgggctgaacaactaaggtatctgtattgccggatatgactgtttcacacagtttttgccaaagaacagaaagagaaatcagtccccttcacttctttccacgctggcagagaagtttgagaaccaaaaacagaaaaataattaaaataattttctcagtttctctaaaatcttctgtctccgtttgtttatcgccttctgtgacaatccaagtaccgaagctacctcccgttccgtccgttcctcaaaatagagttcctgaatcaaccactgttcttctttcgagagttctaaaaggaatttatgtaactgttcacactctatttttttcagaatctgatcctcaacacttctgttttcttctggaaattgcacagccatttcctgcaggcgttcataggaatcctctctgctaggaatggtcattttctctcctgttttaggatctacgatatttcttgctctttttaaatcatattcctgatactgcatttttctttcacttgttctcaatacagcgattacttcctcgctggcttccggatacatttttctaaaatccggtatcttatacggttttgccatgttcctgtcctccttagttttcgttgggtggtgaaaacgaaggacaagtggcggactacgacataggtttctggcaatcctcaagcaagagcttttctccatacgctgctccttagaaaaaaagaagccaacgggaggatcccgctggcttttaacaattttgaaattggatgcagcgcacaaaacactataaaaaaagatcccatacatttctgtatgagatcttctcgctcagcacactgaccatccagtgtactgactataacatgagagaagtcggactttcagtaggactattgtcggactttagtcggactatttaattgatatgaagcgttctcggtttgcttccgtcactttcaatcagatgttcttccttcaattgccgaagataaccatgcacagttgatggggaacgataccctaaaccttttccgatatcccgcacagtaggcggatatccatacctttttatgtattgctcaacaaaatacaaaacttccattttctttttgttgctcataaaaccacctctcctctattcataaagtaacggttcttccaaagcctgtttgatttgaggaagagcactcccccaaagggatagaccgaatattttaattgcttccttttttctatcataatatgtgcttctttccatccgaagcgtttccagtaattcaggctctgtatatcggaaccggcttaaataacacttaaacacaatgtcaaaataaagctgtggtgaatatggaaaatcacgcattttaaccatggccgagtctaccagttccacaagccacttagtctggaacaggctttttactgtttcttcaaacttttccctctctacagtaggagcaaaatcattcagatatagaagcccctcctccagttctctgccataacaatattctgcttcttcacgaagcattgcagcacggtcacaggccgtccagcatacatttcgataaatagataataacaattttgacctttcatataaattttgttcatccagatgctgcatcacacacagcatctgaatactgttttttgccaatgagtttttccgtcccataagcccctcctatcttaccggttcataactcccggcataatcaaaccatgatctcggtattccggcatcttcagatccttcatcaaggccgctggatagatagccctttttccaaatcgccgccgaatttcctcaatcgccagaaatattttttcttctttctcaagccggattggatccgaaaacaaacagatttgctccggttcttttgctgataccaagttgattgcacgaacagttaccgaacgcacaggttccttccaatcataatttctctgaaatagttccctcgccagtttagcaatttccaaaggcactatcgtcggaagggaaagttgaccttgatactgccttgtaaatagttcctgactgcgaatcgctatctgaaccccctgtgctttcaatccatgaatccttaatcgatgtcctatgtcctggcataattccagaataaccttccagacctcctcttctgttttaagatctgctgtacaagtaattccatgccccacacttttcatcggagacacaaagtccttctccattaccggactatcatccagaccatttgcatatgaccacagcatcagcccatttttaccaagaagctggttcacataatcatgatccatttctgccagatctcctatcgtataaattccaacttgctccagcttctttgtagttgagcggccacagaataataattccgatacccgaagcggccaaaccttttgtttccattctgattcttcaatgctagttatggcatccggcttcttcatatcacttcccagttttgcaaatattttattgaatgaaattcctatactaacagtcaatcccagttcattcttcatcctgcagcgaatctggtctgcaatttcttttccagaaccataaagaacctgacttgctgtcacatccagaaagcactcgtccattccgtaaggctctaccaggtctgtatattcctgataaatctctcttgccatattggaatattttaaatactgttcatactggggtggaaccaaaatcaaatccggacaaagtcgttttgcctcccagttaaccattcctgtttttattcctgcttgtttcgctttctctgattttgcaagaacaattccatgacggttttctgtggacccgcacactgctactgcttttccctgtagctctgggttcagcatcatttctacagaagcataaaaacagttcatatcactatgaaggattgtccgattcatattctgtaccctcttccaatttttcctagcaagtattagcacacttattcttgacagcttgcacacttaccattataatgtgcatatagtcactgatacttgccaactcttgctaattcaaatattagcaactacatgcacacttgtcaatagcacagttagcaagtttacgcacactaaaacgaatggaggtctgacatgaaatcttttggttctaaagttaaagaacaacgcggaaatcttggattaagtcagaaacaattagcagaaaaagccggaatgggtatccggacaattacttcttatgaattaggcgaaagaaaaccataccaggcacagctttataaactggcaaaggcactggaggtatcaaccgagtatctgcagaacgataacatagaggatccatcttacggcttagaccgcatggaatatgtagaagatatgagaaaaaatagcggaaccagggaggcgttggatctacagaaaatgctggctgagaacacagctctttttgcaggaggcactctaagcgaagaagcaaaagatgcttattttcaggcagttgccgaagcatactatgactgtaaaaaagcagccagaaaaacctttggcaaaaagaaaaatccacaataatcttctcccgtaatatagtccgaaaggagggagctgttttgactattcaatccatatctgaagaagtcagacggatccagaaaaaatatggtgaatcggatccattccgtctggcacaggcaatgaaaattatcgtggtattaaaaccgatgggaagatataaagggtgctgcaaaggattttatgttcagcaccgcagaatcaaacatatcacaatcaacagcgatttaccggaagtgattcaacgggtcatactggctcatgaaattgctcactccgtgcttcatacaaacataacggctgcgtttcatgaatttacactatttgacgatacagatcggcaggaatatgaagcaaatctctttgctgccgaactgctgttatccgatgactgcgtattaaatgcattaaacgaagaccagtttttctttcaggcggccaaagctctttatgtaccagcagaattactggactttaaatttcgtgtcatgaaacgtaaaggttataaactggagtctcccatcgtatcacatgggaattttctgaaaacaattgaataggaggactactgatgaacgaagatactatccgcgatatatattatgtagaacataaatggaacccccattttttctatctttccccaaaatcattttgtcaggatcttgaaaaaaatggctccgatctataccttgacttgttccatgccatgtatcaggaagagtctgattatatttgtccatatacggaaaacgatttttcccttagaaaaaaactttgcaacaatgggacaactatcatctatcagcttattactccatctcctgtcctctcccctcttacccggtgtgtctatttctgctgtcaattagataagcagcaatatttttactatacctctgagctaacacataccggtgattatctgctatgcggatggacaaaggatgaagcacatctcattttccattcagatgcatctacacttgaggaagaactggaagaagttaaaaaactttttaaggaggtagaactatatgagcggtgttcagacagactgcaaggtttatgtaaacgtaagagcagccttccttccagacggaaaaatgcttccagaagaacttacctgggaagatggaacgccttatacaattgaccgcattttgaatgtgaaaccctctgttgcaaggaaagctggaggtcagggcgactgttatacaattttggtaaacggaaagcaaagccatctcttttttgaacgcagtacaaatttaacgggagcttatataggccggtggtttgtagaacgaaaatcttaaccaaaacccttatataaaaaagatagctgtcattttacgatataatgtcaactatcttttttatatggcatcattttatattaacgcattccagacgcacactctcccatattaatgtccagcacccctctgggcggctggatcagggcgtcctcatactggcacttccactgaatctcccggcacatctggccatccgcaacgccatctatggtttccccatcctgaatggggttatcatgctccaatatgtacgatgccacattgtaggcatgttttaccacccagttggggtccatgtcgtggaagtggtattggagatccggcaaaaacagggtgttcatgcccaccgtgtcgatgagcatatcctccgtgccctcgatattgaagaagcggacattgaccccaaagcggatgaaccgatctggaccctcgatctgatgggagcgcacatcctccgccagaaacagcttgccgcagttctggaaatagaatgcttcgcatgaggggtacagctccgccagagcctccagaaagtcggtgtccaggttggcccgctccagcgccggaagcgccgccgtcagcatatcggtagctaccacctgatatttgcactcccggaagatccgctcccggtcctcctggcagtcccacatctggctcatcaaaaaggcatcgaagcctttgcccttgaacttgtcgcatttcatcaccatcagctgcaccgggcattttccatccttgaactctgcaatatgatcctgtgcggcaaagccggccattttcttatcataacaaaagcactctgttgatccgatgtgtttctccattacggcagtcattttttctttttccggcatgggcaccggttctttgaacagcatctgaatgagataggggcctccgggctgggggccttttttgtcatccaggttttgctggaacactttattgctcatacttatccctcacttttcctgatggcatcttcgatctgtctgctgacggtgtccatataaagatacaccccatcccgatcacagtggtacaggtttgagtagcttgtactctcattagggcggatagggttaggctccaccacctcggtagcttccagcaggccgacacccagttccgccgcggcagtgagggcctttttcagcactgcaaactgtccatcgctccaaagcccctccagatcctccagcacctttggcatctgctccagatcccggagaagctgcacaacctgcttcggagacaggtacacaccagagcagtaattttcgatgatctgattttctgccggattgggaaaggcggttggtgccacctgtgcccacggcgtgaaataccgggcatattccggcttctcctccaacaggaaggaaaagccgcttccccgggtgtaatagtaatctcggaaaaaaccttggattacagcaatatagaatccgtggcttttgtcaaatagctcatctggtgctgtccttgccccgactcgcagggtatccagatatttttccgcatagaagtcctccattccatgctgtgcggcaatgaccagtaccttttcctcctgtcccttctgtatccaagttaagggagtaaaataccattctcgcatttcctctggggaaatcgggtgaaaactcacatcgtatcccataaaattctcctttcactcacactcaggtgattcctctaatgaacggataatctcttgcagttcagcgattgcatcttctacctgaagtgcggtttcttcactccaaaaccgatttcccccagctaactgatcaattagattaaatatggcaactgcgtcagggatagggatagctcccgctaccttccactctgtctcttttttgtgaaggtaggtttttatctctccaaacaactgctcatgaaagatattattacaacgcagttccacaagaaatccattttcgccataaactatatctgaaaaatttatgttcaaatattccttcatagacacatcctcctgcttaatcccaccagaagtaccaaacagtggactgccgcagcacatcggccagagcgcccacggtggcgtcctctgggccttggtcaattacatcagggcagaaaccgtacagctccaccgccacatctatggcctctttctcggaaacaggagccgggagcaggaactccaactcgtcgtggctcatggcagcaggcaccgccccatgctgttcaaaccagtatttcgcaactgccattaactccggcgtgtcaggacactcattccagccaccaaagggcaggtaggcgaagatctcccaagggttcttcacggggattttagccagaatgagaggataggtcatattattatcggaattccagtagcttgaaaaacgacggttatcatatccgccctccatctcgcccaggatctcctcatcccagtccatatcgtcatcctcggcttcttccttgcgctgcccaatcaattcctccaggactgccttactgttcttgacgggggcggagagcattttcttccggtattcggcaactttgtccggggcgaaagtatagtcgtcctcgccatcgctgtccgggtcggaattcataatcaagcattcccacaagatttcgtcatccgccttaatcagaaccggcacaaaaccctctttgacactttcccttttggcatagttgtatgccaacatgatgggatcatcgtccttcatcgagggaaaataggtgcattcacagttcagatatttcatcatggcttctgcaagatccaaaggctcatcctccgaataaacctccggctcactgttttttcttgaggaccagaaggcatccgccttcgtaccgtccgggttcaggaaaatctgaaaatattgatcctctccaggctgttgatagacaaggccgatgcgtcgtagctgatccacaaacacacctgttagaatgccctctggttctccttcaggggtgtgggtcagccatttcccgctgtccagccgttctttgagctgcagcagccagtccgttcccatcttagagagtccggcttcgttcatgcggaaggaaagctccacaagatgctccttcaccgggtattgaaattcgcagcagggggagtttttctcatagccatacttctctgggcggaacagctcataaaatacggcaagccccgcttcgtccacccggatacaggccaaagcgcgttgtttatcatctgcatcctcgtccagcccctgctggagcatctggtcggcgccgggatcaatccaatggtactccatctgttctagggcggccccagctttgatctctttttgcagggtcaaaaactcatgatcaccaggttccagttttaatccttgcttaacagcatccagcgcaccagctttattaccaaaatgagcccgcaatttacccacttgtagccaaacccaggggtaatccggctcctcctgggcacccttttctgcgtagttgagtgcttcttccagtctgccgcagtacatcagcgccacagaataccgatagtaccaagtagcgcagcccacggcattttcctctgaatccttcatccattccacagtacggtagtagtggatatagtcatccaggttgttgctggcgaaggcataccagagggcaatctgcaaatcccgatgcgcctgcttttcgctgaatcttccttcttctacgccgcttttgataaaattctccagccagtcgagcattttcccaaagtaagcggcagttccttcgtcaaaggactccagtatttcaatatcctccgccgagagcagggagccagtttcctcatgaatatcaggctccggttctttctcgtccaacagcggcacaccgcccacatcccgccggaatgcgtggaagtgagcatagggcaggtcgcttccctcaaagaatgcctgtgccgctgttagtacagcgggcagatcccaggcgataaaatccagatacccacaatacagaccagtggccccacccaggaaggtcacggcttcctctcctgcatcccgcaggatggcatcccgcaggttatcccggaaatccagaatggctttcactcgttcctcaccggtaaaaccggacagcgggtacaggaggaatccagcggcaatgccatccttgtggtactcatccaccatatcactgcgggctgtcagatagtcgttgatgagcaccggcaggcggcagcttccagtatagacatccagccgccagtcagcctccgggtcctccaccggttccagttcataggcaaggtagctgttttccaggtaatcgctgccatcccgccagagagaaagtcccatgctttgcagcaactccggcagttcagaaagcagcttagccggttcgtctttcggttgagcataaacatcaaacccagcaacaaaggcgatagcggaaacttctccgatggtttgatccaccagcatagagagtgcccaccagatcttgtctgtgtcctctttcaagatcggcgtcagcttttcacagtaaaggaccagacttacctgatgatcttctgtttcctctgcccacatctgcacatcttcagcccgaacttcgatttctcctgcccgcagctcgaacccctcacagggctggcggcctacccagatattccaatgctcaagcaccgattccggggcctgcttctggaagtacaccaacgggaacaggcgggagcgaagcccctctggactgaggatcaattcatgcttttcgccattgaagcccagctcaaaggaagtatcacgcagggccgtcttgagtgcattcccgcatttttcaaccagttcttcgccgcgctggtgtgtttcgtcagtatctatgatttgacgcagttctgcctcaatctgagaaaaggctgcccatgcttcctgcgtcctttcacggaagttcttttcaaagcgaggcagggacaaacgacggcggcaatcgtttatgtactcctgagtatctttgtctccgggtcgggctttcagagccttttcaaagtaacgaagggcggtgccttcctcatccagaaaataataagcggaagcgatccgataattccagcagtgatcttcggcaaaatactcctcatggggagccagaagttccagcgccttttcaaaaggctcccgttctcctatatgtgcaacagcaatatatgccttggccaattcgctgtccagttccgaggtgcgctcctcggcaggaatcgcttccagggcgtcgattaccttctgtgcttcatcctgttcaaaccattgctggcattgtttcaataaatccatctcatgacctcctcgtttatgattgagtttctaaatagaatccccatacgcagttggagaactctccagcggcaaagcggtaattctgcccgtcaatctccacctgccagacctcaaaggtatggtcttggtggtagatcgggtctttgacttttactcgcttgccggtggtttgccagtcgtagtcaaagatgttcacaccgaacaatttgcattgaccgtctgggccaaaggtttcatatttccaagccatgtgatgcctcacaatcctgtccgctgccagccgttcagccgctcctgcaccgcgtcgatcatccaaacctcgcccacacgcttcatgaggaaacggcggtcaaagccggtatttttctctctggtgtagatgtagagcttgttcttggtgatctgctccgcgtcaaggaattcttcccccttgtaggtgccctgggcactgtatgagaggtccagaggcagatagcccggacggggcttttcgctcacatacttctcccagatcgccagcaggcggggcacagcctcgggatcttcaaacccagcctgctccatgtactgctcccattctgtcatctcggcaaagaaggcagacaacaccctgcggcattccgacgctgcctgctcatccagctggacgggctttttggccttttcccgctggagctgggagaagtgttccatctgctccttggcaaattgcacatgggacaccggcttgatgtagttgttgccggcgacagccagcagtccatcataagtaacagcagtgtggtcaatccagatatgagagagcttggggatggaggctgcctggagcagaccggcatcatccagcccggtgtggtcaagggtcagcaggtccagcttacagctttgcagggcggacaggccgctgccgtcgatcccggcgttcccggtcagcagcaggatgcgcagcttgggcatggcggaaaaaactgggaaacaggcgtcggtgagggtgccattttccacgccgaagttgaccatgcttttatgcccggcaaagggggccagcagttcatccgtcaccggataccctttcacatggaagcccaccagggtgtaaccggccaaccgctccatgatctctgcggtcagcttcggaatatcaaatttcttttctccatctaaagttaggacaccgttttcccaatccgctgttcgtgtccgttttggccattccatagtttacctccttactcttgcgctctatctattaccattctccacccggatgtctgcacccggataacaggacggaaaaagtcatagtcattgtgaatctcgttatcttcccgaacctccggtttacagtgaggggaacagggtaaatatccaagcaaaggacccatgccaccgcagacattgcagccaccgtcgccgccgcaggtggtcaatgttttcccgtctaccagttcccgcttataggggtcgtaggcaatagacaggccaaagaagttgggctgctccatgtcgtatggcctgccctgatcttcctcgctttcaaagtggtgcagtttcatcttgtggtccagtccatccccccatggaaacagggtgcggcatccgcctccgcacagataggcccactcatccggcgtgggaaggctggctgccacctcccacaacagggagcgctgaaactccgggtaggtcattggatggcacagccacgctcgccagctatcaccattgcgttcaaagcggacagtttcatgtatctcaaaactctggctgttctggcccgcccacttctgcaagttctccagccagtcggggtgggcggtgatgcgtagatcgttcatgggtacactttcccagccgatctcctccagttttctgcctacgaacatggggccgatggtcacctggcgtactggggtcatgccctgccggagaaattcctccacagagccctcatattcgatttccgcaaaaatatccgccagttcctcttggttggccttgtccatctcttggacaaagctctcccagccaagaatcacggtatcacctgggacaaagacaaactcccggccacctttttcaaacaggccggtggtgcaactttgtccccagcgggaaaaggcgtatagttctttgaatgtcaaattataacgagtcgccagcgtctgcatcagccagagcttatcggacagtttcaaggcatcaaattgtggtcgaaataaattctcgttcatatcaagtcctctttcaatttgctccggcagactgtgattccttttccacaaggcgaaccgcctccgtcaacagcttgggaagctgattcctttctgctgtttcatactgctggactggatgcgtccaatcaaaattttgaatgatagaaatgatatatctgtcctgataccagcccatatccagcaagaaactgtttggatattccacttgcagcatatcttcttttcgtgtgtcatccagaaaggtgaccgttccggtaccaaaatccacctttgaccaaacttgcacggcaaaattcctcctcacgattctccgaaatgctccagatacaacttccgcacggaatagggaccaacaagggtcgtttcctttcggccatcccaagaatacacatgaatttcgccttcatccccaatgtaccgctgttcctcaaagggtgcaggaaaggggaagctttctacgatgctccagtcaatcttgggcttcagcccatcaaactcctcgcgcttgagccttttgaaattgaacaccaaggccgctccaattccatcgaaaagcaaatctgcgtattctctgggggtaatattctcgctcacattggcagctttgatgtccacattcagaaccttgtcgccgcagtttgtccatattttattgggagagaaccaggtagtccgatctttgccgcctgcaaagtcctcgcggaaatagcttctgttggcgctgtccatctcgaccccttcccgaagcaagccgttgtatgaggaaagcggaaaatatcggtgttttgccgggtcaaactggtcaaacgaaatgtccaacagatacccatgcttctcactgcgcataagcttgtgtggcttcacaatgttttcttcgatgaaactccaaatgtactcgtccacatgaatagatacacgagggcgactgaataatgtgattgtgtagtgatcctctctgtccattctctccgtattgaaccaaatacgatgaattttaaccatagttatcccctcgcgtaatttctgccaacgacacttctgtttccgcctaaaaaagtagttcaccgaaaaacagtctaagaagcacggcagataatgtttcaagctgtggcttgctgagaggagtgtagtgaaggacgatttccccatacaactccgtgttgatgtggtgttcttccagataccgcagaacctttcggttgttccgcacgatatttagacgaaacctggtattatcaagggcatattcaaaacagtccgggtcaatcaactgaccattgactggatcattcatttccaagcggagtgcttccgcgccggtcttgcgggagagtgtaaagtaaccatcctccagttcaaaggacaggcaggacagcccttcatcattgtccagctcccaagtcattctttttgcaaataattccattggcttacctcatatcaacgctatcatactcagccctcataactactccaaggtcatttcacaaagaaccagcttgtctttctcatcgctgagaaatgcccgatttccccatacatccagcacatggaaggaagcgtatctacggggcatggcaaggtcgatcagcaccaaatccgaaaggcgcagcaccttttgtttacccttccagtcatcattcttaaaaatgggagataggatcaggcaagtcctgtcaccggagaattttccgcgcatcccgtgttttccgggcaggcggcttaaattatctttcccccacagtttctttttgaatagtccgttttcctccagttccagataccaatagtagcccatgagagaaagacccgccggattgatagtgctactttccaaaaaggcataaaactgtccattctgttccagtatggagccaatcataggatagttgtagtgaaagtctgcctgggcaaaattgccgccagctcgctctaccgccgccaaatgggtctgtcgggttcctgctttgctgtatacacaagagccgctttctgcccagtgtgcagttatggcttcaaagtctaccgtcaggctggtaaaactgttggtcgcatcagcggagttgtccactcggcacacaatagggaaaacgctatggcttccggtgactgccaccggcttgggaataccctgggcacaccagttatccatggggatcgaaatccactctccatccatctgcggcatccaccaaagggatttactggctgggcaaaccaacagtattcctctgtcgcatgaaagcaagacaggaacttcccaaacatcttgctgctctttcggctctgggctgggaatccacctagaaacttcgcctttgacccacaaaacgccgctgcactttttcaagagatgataggtccaaaacacaatttcatcttcgctgcgggctaccatacctttgcatccagtcgggctgtatttgaaggaagttcccgtcagttcaaattcctcgaactcccagttctttatcacatttagtttcgctttcatactttcacctcacagcaagtctaccttgataccgcaccgttccagaaccggcagtacctgttccggcttggaggacatgagggtaatatgtttgagattggggaactggcgcagttccgcctcagtaatggtattaagatcaaaggctccatcctcgccatcccagaacggacagagctgggtataaatctcgctgccgccatccatctcgatctctgtgaccgaccgggccagccgctccgggacagggtattgttccagccacttccgaatctccgggatgggttcatacccttccgcgtcaatgtcgatcttgcgtcggctatactctctggcaaactcatgggcatccagtttaggagccagtaagcctttctcgtacatcaggacttccatgaccgccagcttgaagttgaaggtatcaaagtgcagcactggttccgtcggcttggataccttgtatttctgcgccttcgccgtctttttctctggctctttccagctgatctgcaccatggcggagagggcctccagctttgctttctgcgctgactgctcctctggaacaggacccggcaagcgggtataaacggtaaagccgcctaatttgagggtatgggcaaatccggcgaaatccttccagctggcctcccggtagtccttggacccgatccaaaccgctccgtcaaatgtctgccggaccgcatactctccctgtgccgccacccggacaccaagggttttgatggtctgctcatcttcatccaaccagccctggagtccaagctcgtcccacaaagcaagtgcctgggtataggaactctctcggccagtcatggggcttttccgtgttccattttgcaggacaatgcgggcgggtcccagctttcccgcaagctgcgaaagggtaaacggcggcgtaaataccgaccccaggatggtcaggctgtctttcttgagaatgatttttcgctctgtggccttgggcggtagaaagatgggcagattcgggtacacttctttgtagtcccgccattccagctttttgggcttgtttgccgtccgcaggaagccccagaagtcgatgggataacgaaataccggcccaaccctatcccgccgggtgacgatgaccaccgtgctatcggtgagtattccaatgtgctgtattttctccccgccgaacattcccggacggatacgcagcacttcacgggtgttcctattgatgagctgggcaaagtcatcggagaggatttcgccgttcccctgcaccagcagccagtccccggtaaaccagcgaattttcaacccctcgcccatgccgggcaggggggcaattcggcaccgcccggtgtccatatccagttccagcaggcattcttccatccgcccctggccactgactgcgtggatcatggtaatgcggcctgtgccgggaacgggaacggcctcggagagatggtcgtatccatccagagagaatgtgtgttttgttaccttgccgttttcccagcggtagatctgtcccttgtaccactcgttggaaaagtagacccggcccagcccgtctgtcgtaatgccgcaatggtatttggtgctccatccatcttccggcagaatccagtttttcacatcctggcaggtaccccggtcagtcagttcgatccgtgtagcgttggtgggatcacccacccagagggaatggtcagcccagcacagggtccggggtggaccgtcatatccaatgggggacggttcggcccagttgagggtggctggattcttgctcagtaatgcccggccaatagtcccgctgccagcggctctggacgcggcatagagttcattttccgcggaataggtgaggcacccaaggtgcggcaagctgtgggagcggattacttgcggcggacggtggcgcagatcggccacacagccgcttttccattcttctgcatcctggtttttccatttacccgccgcaaaatcacccgccagagaattgaagaaataatcgtactcatcctgaagtatgtattcctcgcagggcatcagcttctcagggtcctgctccttggcatggtcgccccattttcgcccttgctgtttcatcaggtgacaatattgcccctgctttttgcagtagcgttcccattcgctgcgttcttcctctgggagcaagacaaacagatactcgtcctcatcgtccaggttatacagcgcccagccgaaggcagaaagttcttgtcctaatgctgccgcccctttttcatgggatagtttcatatattggacgccaacggcatcaaagcgttcatccagcagcgctggaacctgtgcgccccatttttctcgaagttccgccagagtgtcctgcacggctccatcaaatttcagaatgtccagcgcatcatctatgatttgtttgaactctgccataggtagtttctcctttttccaattcctacatcatagcgacagccatgtggtcaaagcactgatttcctcccgcagcagtggggacttcccagcggcggcaaaggctttttggacaccgccatagcgccgctcggagcgatccgccagctggagcgcggctgcctccagattgggaatcgccatcacagcatctgccagcgcctgggcggagagtttatccccaatcagagaggcggcaaagtagcgcaaatggctgtgagagagggcggacaaatcgtttagtttatgcagctcatagagtttcagggcataaagggaaggaagcccatccagagccggtagttcctgcacagctgggagtgactggagatagagtttctgaagccggggcgccagagttaggaaaggggcaagatcttccgttttccgcatttcctccaaatggagataggtaatgctggtgagaagcggggtgatgtcgccattcttttccccacgcaggtggaggacacgcaggccggggagagaaacattgtcccaggaaacaggggccgacagccatagggacagtgtatgaagctgctttagcccggagagaacttctacaccctcacacttttccattagggtcagttcctccagattgggataatctcgcaggaaggacagattcaccttccgctctcccgtcacagacagacaccgtaccgcatctggttttagtccattcagatcaatcttttctccaccgcgccagaaaactgcggtgcagtatgcctgttccattttgcttctctccttattcctcaaactcgccctcaatcattccattaagatattttccgggatcagcaataaattcctcccatttggctaacggatgaaactccttatgctcaatgtccagataccagagtttcttatctctgggactccacagcagcaaatagtcgctgtaattgtccattttcgccataagggagagcaactttttccgtttccaggtcatctcctgtaaatccatgtaggggtacagttccgcccatttcaccagttcccgctctggaaattccagacgcaaggggccggtctttaagtattccaccagcttggcaggcagcttgtaaggcatgagttgacgcgccttttcctgttcgttatgccattcctccggctccagagcttttaagtaggcggccatttcctgatttttgttctgtactgccacggtgtagggccggtcaccgtatttatccgggatggtgatgtctgcaccctgttccacaagccagcgcaccatagaaaaatcgttgtgccgtgcagcttcagtgacaggagtcgaagcgtagggaaacaccatatctggcttgtgatagttgatgtccgccccgttttgaatcagatactccaccagcagctgatttccatggctcgccatactgcgcagggcttcaccgccgtattgtttcaaatccatgcccatccttttcaaaatggggagtacattaggctcatcccgatccaccaagtggagaaacagcctgcatatatccctttgcgttgcggggattctgactcccacatctaccaaaaaggaaaacagggtcaggtcttgactgcgcagggaaccacaaagcaattcttccgggttatgggtcaaatctgctccgcattcgatcaggagctgtaccatgtccatccgattttccagtacagccaattccagcggagaggcttcgtcatcccgcggccaatctccaatcattacctgatagcattgtggctcattgggagaatgccctgcgtgaagcagggaacgaatcgcctctatgtcaccacttttgatggcagccatcatgggaggtacatttgaatagcttacttcactcatccgagtcctccttatagtctattgaaaaatttcctgatacctttctctcagttccttcggagccgtcttaatgaccttgctgccgccgttttcagaggcttgcccccagatggcccagagtaggctctgccaagcgatggcccggaatttcgggtcttcgttttcttccggcaggagataagcggaaaagcgtcgcttgactgccagcagtgcatccaggctttccccattggctatcaggctgcggaattctctggcaggctccagccactgcatagataatgcgccccgcaccaatacccccagcgtccatggttggaacccaaactttcggatcaaggcatgaaggaatttcccttgcagggaggagtgctcgtcatcgcagagatccagatactccgtcaccagcggtgcccacggttctccctccagccccagggcaaacacggcgaaggtgccgggcatcgcacaggcttcatctgagaggttttggtaccactcaaattcccgcatagccagacgagcgtatcgcgccatagccggatgcagattggggtgttgcacagcacaggcaaagagctgattgacgccctttttgggcagaccgggaatgggcagatagagtttttccttcccacggaactccaccgagtaactgcggggaaatccctcctgctccaacaccgcacacaggtaatccagaatttcagcatagcactcctccgtggagtccctggcggtgatgcggatggtagcaaacacatcattggccgatgcggtgaaatgctccgtcttacgccgctggatgtcctttggcaatttgccgctgccagctgttttcagctgcttcaccatatccgggcgaagctgggaaaccagatcaaggtagtgttcggttataatcgtattatcgctggccccatacaccgtataacagaccgccacatagcaagtaaagcgcagcagattctcgtccacatcctccggccgcagctccggccatgcggtacagagcgggaaaggcgaaaagtagtcctcattctctccaatctcaaaaaacctctcctgcacctggtgtttgatgtattttaccaaggtgtggccaatctccctccagcccaccagccgccgcagggcatcgcagaatgtaacagcttcctcataggggaatcccttcaaaggcagtttggacagataccgctccaggagctggctgggaagaaagggcgttccgctttggttccgaacgaccaccggatagccggaatggttttcttttgcagttccatccaacacatcctggatgcactgatcggcgtgttccagcacttcggggttcgtatctggtttctggatcaaataataacgaccttgtacgccgtcgcgtttcggcaaactcatagcaggccaccacttccttccaggttctccgttatcggaataaaaatctgtcggtaaagttccttcagttcctccgaagctgcttccaccactttctgaccacccttggcgctggctttgccccagatcacatagcagaccgtttcccatgcgtattgcagcacttcctccgagctggcttctgtttcctcagcgggttcctcgtcctcgtcatcatcctcgtcggaggaaaaaccgcttggaacgatctcggacaggtggatttttgcctccagcagagcgcccaggctttctgcatttgccatccacgcggtatagtccttggaatacttcatgttctgcatggacagcaccccacggacaaatacagggacggtatcggcggtaaatccgaactgtttcacatactcccggaggaatttttcctgtaagtgggagtgctcatcatcgcagagatcgagataatcccataccagctgctgccactcttgccccagcattcccagggcgaacacggcaaaacttccggggagcgcgcactgctcatcgctgagattggtgtactgctcatattgccgcatggcaagccgggcgtaccgttccatcagggggtggagaccggggtactgcacggcacaggcaaagagctggtttactccctttttgggcagtcctgtgatgggaagataactcttttccggccctttgaactccaccgcatagctgcggggaaaatcctcctgcgccagaatctcacacaggtagttcagcacttcatggcagcattcctccgtgttgtccctggcagtaatacggatcacagcaaaggcatcgttggccgatgcggtgaagtgctctgtttttctcttttgcagagagatcggcagcctgccggtcccatgttcccggagctttttcaccatatccggacggactttctccaccaatccaaagaggtaattggcgtccagatactgaaagtccataccatataccttatagctcaccgccacatagcaggcgaaacgcagcagcggctccgggacctgctctgcacggatacctggttttagggaatactcccgatcccagaagtggtcatcttcattgcctgtcacgataaaatatttctcctgtagctcccgttgcagcatatcaagtagatggtggtcaatttcaccccaccggctctggcggcgcaggttttcgctgaaggcgatggccttttccgcgtcaagggtctcagcccgctgcgcttcggtccatgtccgaagcagttgccacacctcaaagggcgcgccttcgctgctgaccactaccggaggccagagggaatcaagcctcgtgattctcccgtcaatggcatcctggatacactggtcaaagagcggttgcagttcttcctgcacctcgagcttcatccagtaacagcgcccgtccgcactatttcgttttggtaaattcatatcaggccacctctttccgaacaataaaaaatgccccacgccgcactgtcataaagacaggctgacgcagggcatgaagaagccgcgttgaaggagccgcatccaccagcggatgtagtttcttcaacaaccaaaatatttttttcgtatcttaaagcagcaaattgctgtccaatatattgattcatcgcagcaccctttttgttcacatagcattgtttttattataccacatattgttttattcggaaatatttttcttaccctaagttgttttatattcaccaaaaattgatacgcattaacctcacactcaccttcttttttatagataactgtctaattttttctctgattattatagttcttcaagtgataccttctcttcatatgtcatattgccatatcccatatgccaccaagaaaacaaactaatcccttggtggcgtatcttctagctgctgtctatcagcgtatataaaagactgctttttcctccgttttcacgccacctctgttccttttttataagcccagcctttaccagatcctgaatcgcccgttctacagttctccgtgataggtttaattcctttgcgatagtgccaatcgcaggatagcattgtccgtctgtattactccggtccttcaaatacatatacacagctttagcccgatggggcagatctgaagaataaattttagaaaaataagccatctgtcctcctctctgctaatcggttctaagaggtggtcttcgagtagctgccttatgctgtaatttacatagactttacattactggcgggaaacgatattgacgacatatgaaatatcccgtataatgagtatgtgtaaagaagtcgtaaagatatggtaaataatcaggaaaagaggctatagatatcatgggaaaggccctgtgtgacggatgccgcaagcgtgtgataaaggaggcataacctgcaatttttggtttgggatagcgggctatgccctatttttgcccatttttaccggaaattgccgggaatacaccggattatccattaaatgataatatagtaaaagcttatttcctcggacaaaaggagaaaacacatgggagtagaattggttttaagcctgctgggcggcctggccctgttcatgtacggcatgcagatgatgagtaccaatctggaggctgtggctggaaaccgtatgaagcagatattggaacgccttacggcaaaccgttttctgggggtgctggtgggcgccggaatcacggccctgattcagtcgtcttcagccacaaccgtcatgaccgttggattcgttaactcaggtcttatgacgcttaagcaggctgtatggattatcatgggtgccaatgtgggcaccactattacgggacagctcattgccctggacataggggcgctggctccgttaattgcctttgtgggcgttatgtccctgatattcgtaaaaaataaaaaggtgcagcatatgggaggcatcattgccggtatcggtgtcctgttcatcggcatgggcatgatgagcgatgccatggttccgctgagggattctgagacctttatccatatggtgaccaagttctccaatcctcttttgggaatcctggtaggcgcggtgttcacggccatcatccagtcctcctccgcgtctgtgggtattcttcaggccctggccatgggcggtgttatcaaccttcacagcgccgtgtttgtgctgttcggacagaatatcggtacctgcatcacggcccttctggcctctgtgggaaccagccgcaatgcaaagcgcaccacgctgattcacctgatgttcaatgtgattggcacagccctgttcgtgaccctgtgcatcctgactccgtttacggactttgtgattggccttacccctgataatccggtggcccagattgcaaatgtccataccatttttaatatcagcactaccttgattcttctgccctttggcgcgcttctggagaagattgccattgcaatccttccggataaggctgtgcctgttaaggatgccgaccagtggtttgagggtctaatggcttccaagcaccacctgggtatttccaccattgccattaaccagattcacgatgagattcaggtgatgctggcgacagcggcagaaaatgtatcccagagctttaaggcggtggaggacggggcctcagagggaatccaggccataacggaccgggaagaggagattgatttgagcaatatgagactttcccagaaaatctccaagatactcgtattggaccagacgcctaaggatattgacaccctgaaccggatgtataccattctgggaaatattgagcgaatcggcgaccatgccatgaacctggcggaatatgctgaaaccatagaggaaaaaggacttcagttttcagaatatgccaggaaggaattcgccaccatggaaggaacctgccgggaaggcatggagctattgatggcagccgctgccggggacgcggaatcaccgctgtccagggtggctgagattgaacagaggattgacgatataacccgcaagttccgccagaaccagattgaccgtatgcgggagggcaactgcaatgtggagtcctccatcctgtattcggaaatgcttactgactatgaacgaatcggtgaccatatgctgaacattgcccaggcctatgacgccatagagtggtccggggacaggggacagaccgctgcggcgattgcgtgagccgtgtgacagggcaaaagcccggataaatggcgggtcagccggagtggacggcccggcagcaagcaaaaacgggaatttgcccgtatcaattaaatcattgtttgaccaggccttgggggcgccgtgattttaacggccctccggggcctttttgtgctgccgctgattagccgcagccatatttttttgcattgtgcaatatgtacatgacaaatgtcataatgaatattacctatgtaataattgtacacaaaccattggatttatgtttgaaaactgctatgattgggtgcggaagggggaagtaagatgggagaaaaaaataaaaaaatagcagtggccgggcatatttccctggacattacaccggttttccaaaacagcgggaaacagaagctgtctgagctgttccagccgggaaagctgcttaaggtgggaaaagccatgatgtgcacgggcggcgctgtttccaacactggcctggggcttaagcgcctgggagcggacgtggttctgatggctaaaatcggggatgattattttggaaacgcgctgcaggacatgataagggcccatggctgtgaaacctgcatcacccaggttccgggagagaacacatcctataccatagtgctggcgcccaggggactggaccgctttttcctacatgacccgggctgcaatgatacctttggctatgaggacgtggaccttcagaaagcaggggaggcagtccactttcattttggttatccgccaatcatgcgcaggttttaccaggatgacggggaggaactggtaaggctctacaaaaagataaaatccatggggcttaccacgtccctggacctggttgcagtggacccggactcagaagcagcgggcaaggactgggaaaccatactggaacgggttctgccctatgtggatttctttgtgcccagtattgaggaactgggatacatgctggaccgccccatgtactgcagatggcaggagagggcagggggagaggatgtcacaggaatattgtcgctgaaggaggacgtggagccgctggcatccagggctctgtccatgggggccagatgcgtccttctgaaatgcggggcagcgggcatgtaccttaagacagctcctggaccggtgtggaaggagtgtctgccggattttgcgggctgggaagatgtgagccattttgaggacagctatgtgccggactgcgttctgtccggcacaggggcaggcgataccagcatcgctgcctttataaaggccatgctggacggctgcgcgccgcttgaatgcgtccggctggcagctgccacaggcgcatcctgcgtcacggcatacgatgccctcagcggccttctgtcctttgatgagctgcggcagaagataaaggcaggatgggaaaagcagaaggctatccggccataagaaaggagattataaacatgttagtttcaatgaaagcaattttaaatttggcagatgcaaaaaaaatagcggtgggcgccttcaacattacgtccctggagggcatccaggctgtattgggtgcggctgaggaactggggcagccggttatcctgcagtttgctccggttcatgagtccattatcccccttaaggtcatcggccctgtaatggtgatgatggcggaaaaatcttccgtgcctgtatgtgtccatctggaccacggcgataagctggaaatcctggaggaggcgctggaaatgggattcacctcagtgatgtacgacggttccgtcctgccctttgaggaaaatgcggcaaacacaaagattgccgtggaaatggccggaaaccggggggcctccgtggaggctgagattggcgccatgggaaggcaggagttctccagtgtgggggaaggagagcaggcagaggcggtggaaggctgctacacggacccggaacaggcccgggcttttaccgccctcaccgggatagatgccctggcctgctccttcggcacggtgcacggcctatatctgaccgcgcccaggctggattttgacaggatacacaggattcgggaaagcatcggcattcccattgtgatgcacggcggctccggggtcagcgacagggactttaagaaatgtattgccaatggcgtcaggaaaatcaattactacacatacctggccaaggcagggggcatgtatgtaaaggagaaatgcaggacagccggggaacatgtatttttccacgatgtgacccggtggggaatccaggccatgaaggaggatgtgcttcacacaatcagggtattttcccatctggactgagacggaaaaggaggaaaaacatgaaacgttcggaaattaacagggcccttaaggacatggagcagatggttggcagatgttcctttaaacttcccccattctgctgttttacgccagaagaatggaaggaaaaaggacatgagtatgatgaagtcagggataacatgctgggatgggatatcacggattttggaatgggggattttgacaaagtggggttctcccttatcacgctgagaaacggcaatgtgtccatggataagtatacaaaaccatatgcggaaaagctgctgtacatcaaggaaggacagtctgccgccatgcactttcactggaacaagatggaggatatcatcaaccggggcggcggcaatgtactcataggcgtatacaatgccgataaagaagaaggtctggcagatacggatgtcctgatacacagcgacggacgggaatatacggtaccggcaggcacgcagatacggctgcgccccggggagagcattaccatccagccttttttgtatcatgacttccgcctagagccgggaacaggacccgtgctgctgggggaggtatccatgtgcaatgacgataaccgggacaaccgtttctatttgccggcaggccgttttccggtcatagaggaagatgagccgccttaccgccttctgtgcaatgagtaccccggggcgggcagttgtgcaaaacgatgaaaatttgcgccaatggaatctgaaaaagtaaaagtgatgggaaaatatatgacaaatgtcatgcgaaaatgattacattgtgcacatgtgttaaaaagaaaagcgtgataagatttgattacggcaaaaacaacaaaacattttgcagaaggaggcaacttatgaaaaaaagtactaagaagctgttggcagtgatgatgtgcgcagcaatggcaggttctgcactggcaggatgcagcagcggggactcccagacaacggcagccgccacagaggcggccgcgcaggcccagaccacagaggaggccagggaggcggccgctgagcctgaaaaagcaggggagagcaaggaagagacagaggcagctgcggcgccggcagtgacggatatggcatctgccgatgtaaagaagaaggacccggacaagcattataaattcggctatacctgcatggacggaaccaacccgttctttgtcaccattgagaagaggatgagggagatggttgaggccaacggggacgagctgattgcagtagacccggccaatgacgttacccttcagattacccaggtagaggacctgatttcccagaacattgacgccatgttcatgaatccggcagaggcagagggaatccttccggcccttgaccagcttaaggaagcaggaatccccattgtgggctttgacacagaggtagcggatatgtcctacctgatttcctacaccggctccgataactataatgcaggcaaggtctgcggcgaggaccttgtaaagaaatgcccggagggcggggatattattgtactggattctcctaccatgaattccgttacggacaggaccaacggatttttagatgcaattgaaggaaaaggctttaatattgttgcacagcaggatgcaaaaggcaacctggaggtttccatgggcattgcagaagacctgctgcaggcgcacggcgacgtggttgccatcttcggcggcaacgacccaactgcactgggggcgctggcagcagccaatgcagccggtcttacagactgcatgatttacggcgtggacggctctcctgacatcaaggcagagatggcttccggagaatccctgattgagggaagcggcgcccagtctcctgttaagattgcacagtctgcagtaaatatcatgtatacatacttaaacggcgacaaggtagaatcaagatatccggtagaaaccttccttattacatcagaaaatgtagataagtatggcacagatggatggcagtaagagagtagtctgaaaagtgctgggccccttcgggggccaggcactttttaactgacaggccaaaacagcagcgtacggcaggaagctctgtcacgaaccatatgaatagaagaacaggcaggtgagattatgagtgaaacagttctgcttcaaatgaagaacatccacaaatcatttccgggcgtcaaggcgcttcagggggtggacctggaactgagggccggtgaggtccacgcattgcttggtgaaaacggggcaggtaaatccacactgattaaggtcctgggcggtatttacattgcggaacagggtgaaattttcattgacggaaaaaaagcagccattgatggggtaaatgcatcccatagcaacggaatttccattatccaccaggaattggtactggtgcctcacatgactgtggcggaaaatatttttcttggcagagagccgtcaaaagggctttgggtcagccacgacaccatggagaaggaagcccaggagcttctggatgcatatcatatgggcattgaagcggggacgctggttaaggaccttaccattgcccagcagcagatggtggaaatcgtaaaggccatctcctatcattccaggatactggtaatggatgagcccacctcatccatatcggacaaggaagtggaatttctgttcagcaccatgcgggagctgacaaagaaaggcgttggaatcatctatatatcccataagatggacgaactggagcagatatgcgaccgggtgaccgtgctgagggacggaacttacgtgggcactgaggtggtaaaggataccacaagggaccatcttatcgccatgatggtgggcagggagctgaccaagtattacaccagggattacatggagccaggcagggtggtactgaaatgtgagaatattgcagacggaaagatggtcaaaggggccagttttgaactgcatgagggggaaatcattggttttgcggggctggttggcgctggaagaagcgagacaatgaagtgtatattcggactgacgcccggttatacggggagtatcagcgtggatgggaggccggcgtccatcaaatcccctattgacgccatgaaatacggtattgcactggtgcctgaggaccggaagcaggagggactgtataaggtgcagagcgtccggtttaactccaccatcgaggtgctgaaacgctttataaagggcatctgggtggatgcggacaaggaggaggagattacccggcagtatattgagatgatggataccaagaccccgtcccaggaacagcttatcgggaatctgtccggcggcaaccagcagaaggtaatgattggaagatggctggccacctcccctaagatactgattctggacgagcccaccaggggcgtggacgtgggcgcgaaatctgagatatacggaatcatgaacgagctggtgaaaaagggtatgtccatcatcatgatatcatccgaactgcctgaaatcctcaatatgagcgaccgggtctatgtcatgtgcgacggccggattaccggatgcttcagccatgaggagtgcgtcacccaggaacaaatcatgaagctggcggcaaagtaagaaaagggggaaagtcaaatgacaaccagattgcagaaaaatgtaaaacaatattttaaggataatatcggcattatcggggccctgcttattttgtgtattttcttatccgtgttcccaaagaccagcggctccttcctgacccagaaaaatatattcaacgtattgcgtcagatatcgtccaacctgttcctggcctgcggcatgaccatggttatcatcctgggcggcattgatttgtccgtgggttccattatcgccctttcgggctgctttgcagcgggctgcgtgtcccgttacggccttcccatagcagcgggcgtgctgtgcggcgtgctggtgggcatggcggtgggtatgtttaacggcgttgtcatatcaaggacaaccataccgccctttatcgtgaccctggccaccatgaatgtggcaaaggggctggcctatgtgtatacgggcggctctccggtgcgggtggtcacaaaggagtggcagttcttaggcgccgggtatgtgggcggcgttcccacgccggtcatacttttggcagcagtgcttattatcacggctatcatcatgaataaaacaaagctgggacgccatatctacgcggtgggcggaaactcccaggcagccaggttctcaggcatcagtacggccagggtaaaattcctggtacatacctattcgggaatcatggcaggacttgcgggcgtggtcctggcatcccgtatgtattccggccagcccacggctggcgacggagccgagatggacgccattgcagctgttgtggtgggcggaacctccatggcaggcggctccggtaaaatcggaggaaccatcatcggcggcctgattatcggcgttctgaacaacggcctgaacctgctgaatgtgaattccttctggcagtacgttgtaaagggaaccgttatcctcctggctgtttttgtggattacctgagaaacaaaaaggcggaataaagcctggtttgcggcaaaagcgtttcacggcagtggggcgctttttgtcgaagtcaaagtttttcaaaaagttaccatgagatattacagatactcatgtttgcggtataatgggaaaggaccggaccgggagcgtgaccgggcagccggggatatgaccaggcatccgggaaatgaagtcagagacagggaggcgggaagcagatgaagataggaacaggtttgttaatcctgacagcgggcatcatgctcctgttggagggctgcggccgcccggacggaagcgggcgccagcatgaggccaggctgttcggggcaacctatatgaccagaaataatccatattttgatgtcctcaaccaggggatagaagaagtggtggaagccaacggcgatatccttcttaccagggacccccttcaggaccaggaaaagcagaaccagcagattcaggagatgatagacgagggtatccagatgctgtttttgaatcctgtggattgggaaaaggtgcagcctgccctggatgcctgcaaggaggcgggggtgggcattatcaacgtggatacggtggtgaaggacagggattccgtgatttccattatagagacggataactaccaggcaggccagctctgcgccctggatatgatgaagcgcaaggacaaggcgaaaatcgtgatactggacaatcccatacagacctccattaccaaccgggaacagggctttttggacaccatagagggcaatgacaactaccaggtggtatacagggaggcagcggcaggagagattgaggtgtcatcccatgtgatggctgaccttctgcgccgggacattgattttgacgtaatattgggaggcaatgaccccacggccctgggagctctggcagccctgcagcaggccaggagggaggagggggtcctgatatatggaatcgacggctctccggattttaaggcaatcctggatgtggggtatgtgacaggaaccagtgcccagagtcccaggtccataggcaggaaggcggctgagactgcttaccgttatctggacggggagacggtggagaaatacataagcctgcccagcaccatgattaccagggacaatctccatgaatttgaaatagacgggtggcagtgaggatatggatacgaatatggataacaggcgggtacgcatcctgcagctgggaatcctggcgcttaatgtgatatccgtaatgggactcagcatatttatatatgccacaattgaaaacatacggcgcagctatgtggccagggagtttttaagcggcatccaggccattgtctggtatccctgccggaacatctggctctgcgcccttcttctggctctgctggcaggcagtatgtttgtgcgggaccggctgttcccggacaacagtaaggtgattctgttcagccttgtggctgattttgccatttgttttgccattattatacttttgaattttaactataacggtatcctgctgctggtattttccaatgtcattctctatgccaaaaacgggaaatccaggtatttcctggcggcggtggctatcggcagctttatcctggctgattacgaactgctttccatttcctaccgcctgtattccatacaggattacattgcattttacaatgcctccgcccagcagtacctgctcagcagctacaatatcctgatatccctgaatgtaatcatgtttgtggtatactgtgtgaatatcatcaaccagcagcagggaaacctggacgagatacatgcccttaacgagcagcttcaggaagtgaatgaacagcttaaagagtactccgtgatggcggaaaaaatggcggagacaagggagagaaaccgtctggccagggaaatccatgataccctgggccacaccctgaccggcattgccgcgggcatagacgcctgcctggccaccataggcacgtcgccccggcagacaaaggagcagctggagcttatttccaaggtcacaagggacggcatcaaggaaatacggcgctctgtcagccagctgcgccccgatgccctggagcggttcagcctggaatacgccatcagcaagatggtatcggacatgaacgctgtgtccggcgccagggtgtactttgactgccaggtgaagaacctgaaatttgatgaggacgaggaaaacgccatttaccgggtcatccaggagggaatcaccaatgccctgcgccacggccatgccagccagatatggattaccataaagaaggaggatacggacatccttctgcaaatcaaggacaacggcatcgggtgcagggaaataaagagcggattcggaacaaagcacatgaaggagaggattaagatgctgagcggtgttgtgacatttgacggcagcggcggttttactgtaaatgcaaggataccaatccgatggggggagacttatgattaaagtattgattgcggacgaccaggagctgattcgccagagcctgcagattgtgctcaacagcaggcccgacataatggttacagatgtggcgtccaacggccaggaggttatccgctgcgtaaggaagaacaagccggatgtcatactgatggacatccggatgcccaagctggacggggtgcagtgcacgaaaatcataaaggaaaattatcctcagattaagattattatactcaccacctttgacgatgacgagtatgtctacaatgccctgaaatacggggccagcgggtatctgttaaagggcgtgtccatggatgaactggccaatgccattaccacggtatacaatggatgggccatgattaacccggacattgcagccaaggtgctgaggctgttttcacagatggcccaggcggactataccatacttgtgggtgataagaatgtggacgagcttacaaagacagagtggaaaatcatagcccaggtggaaaagggggccagcaacagggagatagcggaaacccttaagctgtctgaggggacggtgcgcaattatctcagcaccatactgaacaagctggatttgcgggaccgcacccagctggcaatctgggctgtccagacaaatgtaaggaaacgcctgggcacctgaagtctggccgggacagcaggcagaagcaggacagcaggcagaagcggagcggcaggcagaagcagaacagaggcaggagataggcagaaggaagggtgagattgggatgaagggatggaaatggacgctggggctgggaacagccctggtcctcctttttggtctggcgggatgtatatacatgtatcatgataaggagatagtcctggaattcggcatgtttacgggaagcaactgggacgttgccagtgccagcagctttgtcatcatggacaaggcgattgcaaggtttgaggaggagcatcccggggtgaagattcactattacagcggaatcagcaaggaggactactcggagtggtgcgccagaaagctgttggagggaaagatgccggatgtgtttatggtgccggatacggatttcaacctgtattcatctttgggggtcatgaaaaacctggacgaactcattgagcatgatgacgggtttgaccgcagtgactttttcaccacagcccttgacgcgggaaaatacgatggacaccagtgcgcccttccctatgaaacggttccggtccttttatttgtcaacaaatcccttttggccagggaacagattgaggtgccgggggaggactggacatgggatgatatgtatgaaatatgcaggaagataacaaaggatgtgaatggggatggattgctggaccagttcggcacctataattacagctggaggaacgcggtttacaccagcggggggagattttacggcggggaccagcagcagttgtcctttacggacccccatgtcctggacgccatcaaatacatgaagcgccttaacgaccttaaccagggacagagcgtgacccaggaggacttcaacaaagggaatgtggcctttatgcccctgacctttgcagagtacaggacctataagacctacccctaccggattaagaaatacacaaagttccagtgggactgcatcacgtttcctgccggaaaagagggagagaaccgttccagggtggattcccttctcatgggcatcaacagcagcacaaagcatgaaaagctggcgtgggaattcctgaaacagctgactggaaatgaggagatgcagatggacatattccggtactcacagggcgtgtctgtgctgaaaagcgttaccggctccggccaggcagcggccatcatacaggaggacatggatgagggggagcaggtcattaacagcagtctgctgtacaatgtaattgagaacggggtcatagagcccaagttccagcagtatgagcaggtcatgagcctggcagacggggaggtatccaagatacttatggaaaacaggaatgtggacagcagcatgaagatattccagagaagcattaccaagtatttgcagcagcagagatagagagaggggagaaaaggccgggccccggtcatttgtacacggtttgtacaatgattggggcccgggcttgttttttatttgtttttggtgtggtaggcggtgggaagattccagtcgtactttgtggccagaaggcggatgagcaccaccaggattgcgctcaatatcatggaggcgtctctggagagccagccgttcaggcagacatagcagacagccccggcaatggaggcggaagcatatacatgcttgcgcaggatatacggggactggccggccagaatatccctgagggcgccgcctcccacgcctgtaaggacgcccaggaacacggagagaaaatgatattccccgtaaccggccgtcacagctgtgttgatgcctgttaccgtgaaggctcccagtccaatggcgtcaaacaggttcattatcttctcataagccgagatataccggctttccagtatcctctggttcagccagaccaggacaaagagtaccatggccgccagaaaggccgtgtacacgtaaaccgggttcatgaacaggctgggcggtacgattcccagtataatgtcccggagcattccgccgccgacagcagtggtgacgcccaggaccaccactcccagcaggtccaggcgctgtttgatggccaccagggcaccggacgaggcaaaggccacggttccgactatttctatgataaaaaagattgagatattggattccataatacgctcccggccaatggctacagcagataaatcttgttttttccgcagatatcgcgcatttccctgggccagatactggcctggacttcacctatatgggcgcggtccaaaagcagcatgcacagacgtgactgtccgataccgccgccgatggtgtagggaagttctccgtttaaaagcattttatgataaggaagactgcggcggtcttcgcatccggctttcctgagctggtcctccagggcagcctcatccacacggatacccatgctggagatttccagggcgcactgtaaatgctcaaaccagaacaggatatcgccgttcagcttccagtcgtcatagtcaggcgcgcgtccgtcatggggcttgccgccggccagtttatcgccaatctgcatcaggaatacgcagccatgttccctggttatcaggttttcccgttccttaggcgtattgtccggatacaggtcctccagctcctggctggtgatgaagaagatatcctttggaaggtgcttcactgcctccgggtatttataccacacctcatgctgcatgtgcttgataattttaaaaatctcccgcactgtgtcctttaaggtatccagattgcgctgttccctggtgatgacccgttcccagtcccactggtccacataacaggagtgaaggttatccagctcctcgtccctgcggatggcgttcatattggtgtaaagcccctcgccgggctgaaagccgtattcctttagggccatacgcttccattttgccagtgagtgcacaacctccagggtttccccgggaagtcccagcatgtcaaaggacacggggcgctcagtaccgtttaggttatcgttaagaccgctgcttctttccacgaacaggggagcggagatacgctctagatgcatctcccttcccatttccttctggaaggtgtcgcgtatgtatttgattgcgtcctgcgtctcacggatggaaagacgggggtcgtaatccttaggtatgattaattccatcttaaaaacctccaaactagttgaattcattgcatatgtttcttatggtatcatcattgggaaaaacgcgcaagtgcttacatcatttttttatgagggaaatggcgtaaaaatgcgaaaataccctggaaagatgttgaaatataaggttacacacagatggaaacatggtaaaatagagttgaaaatgaaatcgggaggtatgagatgaaacgaacggtaaaggtatggctggcagcggttatgagcggagtgattctggcaggaggggcaggaacaacaggacaggctccgtggggaatggagtcccaggcccattcgggccggacagatgccaacggaggacaccgggataacaaaaatgccagcgggttgggaagctaccactaccactgcggaggacatccggcccacctgcatcccaacggcgtgtgtccctatgcaggaggtgcccaaactaaggcccagacccagacacaagcccagattccaacaaaggctgccaatatggttcaggaaacccaggccggggacctggatattccggctgtccgggcagtttcccgggaaagggcggcagatacaacgggatggaaccaaaatgggacacagtggaattatatctgtgaggacggaacacagctgattggatgctggaaacagattgacggtgtgtggtactgttttgacagcgacggaaacatgcggaccggatggtacagggaaaatggctgtctttattacctggggacggatgggaagatggttaccggaacctgtatggtcgatggaacagagtaccagtttgaccaggacgggaagatgataacagagaagcaaacgggcctgcattgataatgtctcaatgcaggcccccggctgtctgtgtgctatctggatttacccgaataaatccataagcttctttttcatttctttccgtcttttatctgtttcttcggtatccagggaaaacaaaccatcctctgcctgtaatacgtcgccttccttaacattctccggaagatggctgacgggaaccgttatgcgctctcttgcttctgtttcacatatggccagaccctcctccagccggtcaatgatatatttcatatagaatatcctttctgtgtgttttaaacatgctccagcccagagaccgtattgacagcatgtaacagctggtgtttgggttacggtttacactgtttacagggctcgtatccctcctgtatcagttcctccctggaagaggttacatccttccggttttccgtcttcatctgtgggaccgaggcacagccggggctgtggaacttgccggtgttaacatttatgacataggaggaaagggaggaggcactgccggagctgtgttcggcggtattgccagcctgatgggtggcggtgctccatgtgattgtactgccgtcgctgaaagcggcaatggtcccttcctcatctgtgcggagtacctggcagcctgcttttttaagtttttccattgtctccttatgggggtgtccgtaggagttgccttccccgcactggattaccacccaggagggtgatacctttttcagaaatgcatcgctggtagcggtgcggctgccgtgatggcctgccttcagcacatctgcctttaacactgcgccgctgtttacaatatcttcctccgcctggttttctgcatcgccgcacatgacaaagctgttatcgccgtaagtaaggcggatgcccacggaccagttgttcaggtcgctgccatagtcttttaccggagagagtatggtaaaggaggcgcttcccaaatcataggagtcccccggcaccggtttggtgattttcagtcctttggaagcaatggagtccagtacatcctcaaaggtcctggtggtatgctccaccggcggcagaaagactctgtccacgggaaaggtatcaattaccttgtccaggccgccgatatggtcggaatggggatgggtgccaatcacataatccattttttccactccctctgcctgcagataagagattacggtattggcctggtcattttcccctgcatcaatcagcatgtagtgtccgcctgattcggccagtatactgtctccctggcccacatcaatgaaatgtacagccagtcccggcccggatggggcggctgtggagtaacctttgtcctgggaaagggctggggcggaatcagcgcatcctcccagcaaaagcgagatactgcaaaaaatggatattatcaatattcggatactatttcttctagtcataaacgagtcagccttcctgtcttttgttggttttagttttatatcggaacaattatttggataattgcggtacccatgtactgtttcattgcagggccgcctgggccaggacagccctgctgaatgcggtatcccactgcgggtaggaacgtttcagggatacaggtctgccgtctgtacccaggaaacagtgtttgctctcacctgtggttttaagttcacctgtggcggcatcgcgcatctcatacgcaagcgtcatgcggatggcgttatattcctttacccatacatgtatttttacatggtcatcaaaatgtaccatggacctgtactggcagtgtacctccagaaccgggctcatgacgcctgaggcttccatggccttatatccgcagcccatctgttccatcaggctgacccttgcctcctccatccagcggatgtagttggaatgatgtacacagcccatctggtctgtctcataatactgtgcatgatgttcgtagtctttaaacatgatgtcctcctggttttattctgaatctatctggtcctgataccaggccgtgaatccttcatcactcatattactggtgtttgtctggcaataccctttcagctgctccttgaattgttccaggtcctcccggtagctgttggaagggagtccggatgtttccagcagacggcatgctgcaacggaatgcaggatggccttgtccaggctgtggccggactcggcatatatggaaaccagggtattctggacacaggcttcagcgtaagcattatccccatcctggttaatgagtttaagcgccttatcaagggcggtgagagccggggaaggctcgccgcgctcctggtacatctgccccagattatagaaggccaccccttttgcataggggtccgctgtttctgaaagggacgccttagtgtagtaatcctcagcggtttcatactccttttgggcatcgtaaatccgcgctatacggatgtaggaccaggtcaggtcgcttccgttgtgttcctggattttaagggcctgccggtaatgttccatggctttttcataatcctctgttttcttgtacgtatctcctatatcgcataaaaagactgccgtataggcggagtcctttccgcaggctttttggatggctttcagacctttctcataataggccagggcctcatccatattgcctgcatccctgtgcacatcggctatggcgctgtaatcccccgccctcattttgacatacatccagaccgttatctttctcattcatcattattttcctttcaggcagtcagacagcatacaaaaatattataccatgaattgtcccaaaaaacgagtgcatgggaatggattggtgttccggccggaaccagaggccgccatagccggcggacctaaaacaacagaggattttaaacagcttatgtatattttgaaatatggttacatatactggtaataaatggacctgtcctatgggtatatacccggaaacagattcagaccagatattatcaagaagaaaaggagcacatgattatggcacggggagtaagaaagtcaccggttgaaaaactgcagggagagctggcggatgtacaggcatccatagcacagtatgagagctgtctggaaaccatgagggaaaaggaaaaggctcttatggaacatatccagctggaggaatttaaggttgtgaacgagatgctaaaggaacgggacatgaccatggatgatttaaaagaaatgctggcaggggacatgactctcagtgcatgagctatgtaatcctgtatatacagtaagtccatatgagaataaggacgcctggatggaaatctgcgcgttcttatttttttaactttattttttgatttatctttcagcttctgttttttgaaggctttgtttgattcctcatgttgtagttgaccgctgttttatggtagaatgataaaaaacaacaggcctgaaggaggtacataagatggtggaagtcacgctagggaaaacaggtatcactgtgaataagaatgggtttggggcccttcctatccagaggataccggaggaggacgcggtacgccttataaagaaggcatatgatgggggaatcacgttctttgatacagccaggaattatacggacagcgaggaaaagttaggagctgcacttgagggaatacgtgataaggtgttcatcgcaaccaagacagcggctaagacagcagagaaattctgggaggacctggaaacttccctgaaaaacctgagaacagaccatgtggacctttatcaattccataatccgcctttctgtccaaagccgggagacggaaccggactgtatgaggctgttctggaggccagggcccagggaaaggtacaccatataggaatcaccaaccacaggctggcagtggcggcggaggcaattgactccggtctttatgagacattgcagttcccattctgttatctggctacggataaggacctggaactggtggagcgctgcaggaaggcggacatgggtttcattgccatgaaggcattatccggcggccttatcaataattcacgggcagcctacgcatatctggcccagtttgacaatgtgcttccaatctggggggtccagagagaaggggagctggatgagttcctgtcctatgtgggaaatccgcctcagatgtcagatgagatacaggcattgattgataaggacagggacgagcttttaggtgaattctgcaggggctgcggatactgtatgccatgtcccgttggaatccaaatcaataattgcgccaggatgtcccttatgatacgcagggcgccttccgctgcctggctgacaccagaggcccaggagaatatgaagaagattgaacagtgcctccactgcaaccagtgcaagggaaaatgtccttataatctggatacgccagcattgctggagaagaatctgaaggactatctggagattcttgacggaaaggaatattaggagagggatacgcaggaaacagcgcccgctgtcatggtggcagaggaagcgctgtttctttcgtataccataaatacgtatattggcaggatttaatcgcggtagcggttgatgcaggcgtatatttcctggattctcggcatggaaaggccgcaggccgcataggagctgtctcccatggcgcacagaccgcccttctgtatctccttaagcagcagggagacggtatccttcaccgtatagcgctccaggagctggtgttgcgcacagtagcgcagcatctgcgccagggtattggtctgctcggaatcaacgagctgttccacgaaccggaggtccacaggggacctgccgatttgcagggaatccttgccgtataccttgaccttgatgcgctcgtcccggcccccgtcatgggaaccccggcccctgtaaccgccccggtttggaacagcggaattcctggatgcggtctgggaaccgcccttactgctcaatagcctgcgcccctctgcgggaagaaggaagcctggggcagaagtaatgggttcgacgccgtagccggaacaaaaggctttggtcttatctgtgatgtcaaagggctcatagcagtccatctgcaggatggtatctgcaatatagaagtaagcgcctgaacttcctgccaccatgacagtggaaataccggatttttcatacaaatccctggctctttcaatgaagggggtaatgggctcctggtcacggctgatgattttctgcatcaggtcgtccctgaccatgaagttggtggcagaggtatcctcgtcaatcaggaatacactgcttccggcttcaatcccctcaatgacagcagctgcctgggaggtgctgccgctggcatcctcagtggagaagcaatgggtgttctttttgttgggcaggtcgttgatgaacagggaaatgtccacgttccggacacttctgccgtcttctgcccgcagcttcatggcagtggaatccgtgatgacatattcccgtccatctccggccacatggttatagacaccggactccagggctttcaacagggtggatttgccatgatatccgccgcctacaatcagggtaatgccccggcgcagtcccattccggtgattctgccatggtggggaaggtttaattccagccggagggaatccggtgactggaagggaacgctgcccttcatggggctgctggaaatgccgctttccctgggaaggacggcgccgtccgcaacaaaggaaaccagtcccaggcgttccagctcactgcggatgaaatactggtcttccgccaggtcggctacgtcctttacttcccgggccggcctgctcttataataaaatacagttttaacgcaccggggcaggaaatcgaacagaatcttaaccagctcgccggaattgatggttctgccattggccgggaaaccggcttcaaagcgggctgtgatgcccctggtgctgcattcacaggctgtccggctcagaatctcaggtcccggatggctggtggcaatcaggccgcttttgccggaaccttttgccttgaaattatatttggcgatttcctggcagaactgtctgaccagataatcctccagggcagtctgcttgtggggggcgtcgaaatattcgcagggataggatgcccgctgctgcggaatgaatacgcttaatttggaaggggatgcaaaggggtccccctgtacatggtcgatggaaagtacataatccccaaagtcataggaaccccgcgtatctttataggccggatatcccttccggtcaatggattccagtaatcttctcaggtcttgtgctgatttcatgatgctgcttcacctcttcgcctgcgccgccaggccggaatccaggtccggtctgccttttgacaggctcctttttctgtatttgctttctatattttatagcaggtccggcgaaaatgcaaccaagaacagcgggcggtatgggcttatggggtgcatatatatccggccgtcccggggcggcagcgttgaagggtcctgcattttatggtatgatagtatgagacgggcgccagggcccggagtggtaaagcaggcacactccggtccagggcggctctgccaatgacaggagtgaagaatgaatatggaccagcagaaaaaggaaatgttagaagcactgtccggtgcagaaaaggtactgataggcatcggaggggaatggaaattaaaggacgatggaagggatgtgcggctgcgctgtctggcggacgaagctcagagggagctgaaagctgcttacgaagccttatgggacctggtcagggacaaggattattatgtggtaaccactgtgacggacggggctgtctatgacacggattttgacagcaaacgggtggtggctccctgcgggaatatccattggagacagtgctctaaagcctgtaccaaggatatatgggaggagggggaggtgccggaggatacctgcccccattgcagggctcccctgacaggcaatacggttgaggcagagaactatatcgaggaaggctatctgcccaggtgggaggcctacaagaaatggcagacaggaaccctgaaccgcaaactggttattctggaactgggggaaggcttcaagacgcctaccgtcatgcggtggccgtttgagaagattgcattttttaaccgtaaatccgcattttaccgtgtcaacagacaattttaccagatgccccgggagatgggagagcgggccgggggaatccaggcagattcagtttcctttatccgcggcctggcagagagaaactaataatttctgaaaatagtagttcctgaaagggataattcctgaaacaatataaaatgattacaaaaacaggttgcctttatcacgttacaatgctaaaatattaaatcataggaacgaggtcgaatatatgattgctatcattgattatgacgcaggaaacctgcgcagtgtggaaaaagccctgttatcactgggggaaacgcctgtcataaccagggacaggaagacaatactggaagcggacaaggttatcctgcccggagtaggttcgttcggcgatgcaatgggaaagctggagcagtatggtctgtcggatgtgattcgtgagacagtggaccagggaaccccgtttttaggaatctgccttggactgcagcttttgtttgcaggcagcgatgagagtcccggggccgcggggctggggattcttccgggaacaatatataagataccggagcatcccgggctcaagattccccatatgggctggaactcactggatataaggccgggggcaaaactgtttaaagggattgataacggagcctatgtttactttgtacattcctattacctgaaagcaggggacgaatacattgtggcggcttccgcagagtacagcacccggatacacgcttcagtggagcagggaaatgtgtttgcctgtcagttccatccggagaaaagcggggaagtgggacttgccattcttaagaattttatgggactgtgaaggtcctgcggtgtccggggaaggagtgccgggacagcgccaagccaaataaaacaggagacaggagaggcgatatgtttaccaaaagaatcataccatgcctggacgtgaacaatggccgtgtggtaaagggcgtgaattttgtgaacctgcgggatgccggggacccggtggagatagctgcggcttatgataaggcaggggcagacgaactggtatttctggatatcacggcatcctcagacaaccgccgtaccgtggtggatatggtgcgcaaggtggcggagactgtttttattccgtttaccgtgggaggcggcatacgcaccgtggaagatttccgcatgcttctcagagagggagcggataagatatccatcaattcctcagccattgacaatccccgccttatcagtgatgcagcggataaattcggccgtcaatgcgtggtggtagccatagacgccaggcgcagggaggacggaaagggctggaatatctacaaacacggcggacgtgtggatgtggggacagatgcccttaagtgggccatggaggcagaccgcctgggagcgggagagatactgctcaccagcatggactgcgacggaaccaagaacggatatgacaatgaactgacctccctcattgcttcccatgtatccgtgccggtcattgcttcgggaggcgccgggaataaggaacatttctatgatgcattgactaaaggcggcgcagacgccgcactggcggcatccctgtttcattataaggaactggagatacgggaacttaaggagtacctggcggggagagggattgcagtcaggatgtagccggtgcttttaattggtttcttcccggtacacgcggataagaacaatggaagaaaaaatagtcacttcatccttagtggctattttttaattggtttattcatgttagcgcttttgcacccaataacccgaatccttttacccggccttttcggtctgctgtcccggcctctttcttaaattattttgtcgatatccgttgtttcctgcggtttcctatgctaaaatatgaaaatgtgaattatatggtgaaagaaaaggagaagcaggatatggccgcgattaccaatgactggctggggcctttgagcagtgaatttaagaagccctattataaagaattgtataagacagtaaagcatgaatatgagaccagaagggtgtttcctgaaccggatgatatctttaatgcatttgcatttacaccgctggcagacgtgaaggtagtgatactgggacaggacccttaccacaattacggccaggcccatggcctgtgtttttcggtgaagccggatgtggatattcctccctccctggtgaacatctatcaggagcttcacgacgatttagggtgttatataccgaataacggttatctgaagaaatgggctgaccagggcgttatgctgttaaatacagtgcttacggtgagggcgcaccaggccaattcccaccgggatatcggatgggagaaatttacggatgcagccataggcattctcaaccagcaggacaggcccatggtgtttattttatgggggcgtcctgcccagacgaagaaggcaatgcttaataatcccaggcatctgattctggaggcgccccatccaagtccgctgtcagcgtccaggggatttttcgggagcaggcccttcagcaagaccaatgcatttttgacagagcatggccttatgcctgttgactggcagattgagaatatataaaacaggtatagggtttagtaagaatacataaaatgtacagcaggcaggagcttgtgcggccggagggcagcagggcagggacccttagggtgccgggaaatggagcctgtctgcggtaaggagagcttatgagtttagttgaagtgttaaaaatcattgtactgggcattgtggaaggatttacggagtggcttcccatcagcagcacgggccacatgattctggtggatgaaatcatccgcctgaaccagccggacgcgtttaaggatgtgttcctggtagtgattcagctgggtgccatcctggctgtggtagtcatgttttttcataagctgaatccctttagcccaagtaaaagcagccgtcagaaggacgccacatgggccctgtggattaaaattatcattgcctgtattccggcagccatcctggggcttttgctggatgactggatggaggcccacctgttcaatgcctatgtggtggcagcggccctgattgtatacggcgtactttttatcgtgcttgagaacagcagcgtgtgttcaaatcccagattcaacaaggtgggacagatttcagccaagacagcgttcctcatcggcatggtgcagctgctggctctgattccgggaacctcccgttccggctctaccattctgggcgccatggtcctgggctgttccagggctgccgctgcagagttttcatttttcctgggaatcccggttatgtttggggccagcctgttaaaaatcgtgaagtatttcctggcaggaaatgttttcacaggcccgcagatattctacaccatactgggaatgctgattgcctttgtggtttccatttattccatccagttccttatgagctatgtacgcaagcatgattttaagttctttggatactacagaatcattctgggtgtgattgtactggcgtatttcggtattacggccctggccagctaggaaccaacgatattcctcagctgaaagcagcagaatcaaatcagagtcaaatcagaagcagaataggaatcaaatcagaataaggattttcagaataaaaagggcctgccatgcagagggagatttctgcatgcagagccctgtttatgtgtttagaatgttacgcggcccatgactttcttagtccaggttatccgcaatctcatacaacagccgttgtgtatcatcccatccaagacaggggtcggtgatggatttgccatagcagtgttcaccgattttctggctgccgggttcgatgtagctttcaatcataaggccctttaccaggttctttatatccccggaatgacggcggctgtggagcacttccttggcaatacgaatctgttcctgatactgcttgttggagttggcatggtttgtgtccacgatgcaggccggattctgcagcccgcgtttgttatacaggtcaaataaaagctttaaatcctcatagtggtagttggggttgcactggcccctcttgttcacagcgccacgcaggatggtgtgggtcagaggattgcctgggcactgtacttcaaagccgcggaagatgaagtcgtggggaagctgtgcagccaccacggaattcagcataacagtcaggtcgccgctggtggggttcttcatgccgaccggcacgtcgcagccgctggctaccagacggtggaactggttttccacggaacgggcgcctactgccacataggacatcatgtcggagagatagttcatgttttccggatagagcatttcgtcggcagtggaaaaacctgtctcccgcagcaccctcatgtgcatatggcggatggccagtataccctcgaacatatcgggccgcttctccgggtccggctgatgaatcattcccatatatccctcgccggtggtcctgggcttgttggtgtagacccgtggaatgatgattagcttgtcctttgtcttttcctggattttcacaaggcgtccggcgtaatcacatacagattcctcgttgtcagcagaacagggaccgatgatgacaacgaacttgtcgctctcaccggtaaataccttttttatttcctcgtcccgcgcatgcttgatttctgccagctcaggagccagcgggaactgttcccggatttctgccggtgtaggcagtttattgatgaatgtgaatcccatttcttcgtcctcccattatgtaaacaccgggctgcggtgtaagatgcatttcaatgcttcattatagtatagaaaaccggattcgtaaatagtgaatcccacgaaaatattgacaataaggcattttccaagtataaatagatacatgattggtgcaggagattaatgtgtgagatgaagaatgacaagagacagaccgcaggaaccataatggcactggtgggaggaacctgctggggattttcaggctgctgcgggcagtatttatttgagcaaaagggaatcgaggccccgtggctggtggctgtcaggctgttttttgcaggcatcatactggtgctggccgggtttaagcttcacggcagggaaaacctgagggtgttccaaaagagaagggataccgtccatttgctggcttttgccattttcggcattaccttctgccagtttacatattttatggccatccaggcgtccaatgcaggaacggcaaccgtgctgcagtacctgtcgcctatcctgattctggccgtggtgtgcatgcgggagctgcgccttcccaaggggctggagctggcagccatcgcactgtccctgctgggcacctttgtcatcggcacccacggggatatacactcctttcacatcacaggggaagccctgttctggggcctgctggcagctgtcagctccatgatttacaccattataccgggcggacttatcctgaagtatgatatatatcaggtgctgggattcggcatgttctttggcgggattgccatgggagccgtggtgcgtccctggaattacgcggttgcctgggatgcgggcaccgcaggagccctggcgggcgtggtggtggtcggcactgccgttgcattcggcctgtatcttcagggggtcagcatgattggacctttaaagggcagcattatgggaagcgtggagccggtgtccgctgtcattatatccgtattctggctgggaacccgctttacactgcctgattttctgggctttgccctgattctgggagccgtattcgtacttacctttgcccaccgtccgggttactgttcagaggctaacttgtaaagaaagaacccatggtgtagactggaagcacaaggactgaaggtccaagaaagaactttcagcccagttattatcatagaagattagcttttacagacttttcttcacacactctaaatttcggacggtagttcttatggtaggtagtaggtggctctcaaacttcgaacggtagctcaatgaaggctggtataatcaaaactttctcttactcgtttacccctatgtttttaatattggaagctatatttatctaatacgatattttatcttaacccttctatgattatactgttcctgctgtgtcataagactcaatttacatattatagccattaatacagcaatctcaactccatcatttacaagtattgtttctgtaataagcgaaatgcctatcataagccacatcatattaagcgaaaaagtattttcgttattaattccttctttagttaatccaattaaaaataataataaaataataatcaatcctaaacctataataccaaattgtgccatataatatggataacctgcatcaccaattgcagcagatacagtaccattttcattataaaatcctgtaatatgtatcgtattatataccccagacatcattttggctgataaatgggatgcaaaagtgccaaatccagaacctattggcatgcatatattcattagttttagaccgcccatatataaagtttctcttggtgaagttgaataggaagcatatagcataagcttattataagaaactgccataatgaggcagaaaataatgtaccaatacaaaacttttaatctcttaaaccagcttctcccatattttacaaatacatatatagcaacaaatataaatcctcttgttcgcatacctaaaacaagagttcctaataacataatttcatctatcaaagtacagtcttttgcagcattcaatgctaacagtatcatcattgcaaatgttgtcaaatatgtcggatgtgaaaacaaaaacatataaggatgaattccatgcctatattctaattgagataaacctatattaaaaaacatggatattattccaaaaataaaaattatagctattattagtttaagaaatggaataattctataaaatacagatgcaagtttccgggttagatttaattcacatagtgcgaaaagggttaacggaaattttaaaaaaccaacaatatctcttattatcgcattagctgatagttgatatccaaatataatattccccataagacctacaataattatgctaataagtgtcaagaaaaatattagtgcatcttttttaattctactatttgttagcctaattattaatactataaatattattataaataatagctcatcccaataattaaaaaatccattattaggcaaataccttattattatatctggaaataaaattacacagataaagactatttctaacataataagttacccattttcttaagattttataaaatccgttcataacccaagatgttcagccaaccgactagaactattgccatcatgaaaagtaaacatcttatttaaaaccgattttctttgagtgtaatattcatcttctccattatttagtgatacaaagaaattaattaaattttcaaaacaatatattttcataccaggcataaaatctttgggattttcaactataaaaccaagtttgtattcatttatgtcatcaagtgtatacgcaataggtcttcctgtatgtaagaaatctgttccggaagatgaataatcactaatcattgcatctgcatctaccattagtttataattatctatatctagttctttcactttattaccatctattacaataatattggtatccgaatatattttgatttgttccaaatcctgcattggatgtatcttgattatcaatagtatatctaaactatttagtatattattaagttttttatattcttctatgtcacttacaattggtatacccattgtatattcgattgaagaatcaatgcgattatctatttttgactttctaaatgttggcatccataaaaccaccttattaaaagtataatcagtcagcttgctcaaatcacctgattcaagattgtataacacatcatgacacggataacctaatattatttgtttatcattaggatacggaatcgataataaatcagcctgaattgatttcaagtattcagaaggtgctagaatataagtcatgctatcagaaacagatatattgcctttagtattttttaatgccattgcaccatgcgtcaggtaatatgctttctgcccatctctaacgattcctaatgcgtcttggcaagttaatatatactttgcatttgacagatagtagtccttttttaaacttggtttatatattccatagcattccacattttgtggaagagcctctggttttttattcctaataagccatactattttatacctgtcattatatttgtttttaattaagtaattataaaaggcccctccgttcgaatcaaaatcattatgactttctataataataatattttgtaaattttgatttttaaaaatcactgcaaatagtcgttgtattacgaagtcaatcttatatcgccaaataacctggcaagttctttttaatcccctttttttaaggtaatacaatatgttcatctgttttttaacccctctaaacacttagaagctttttagctaccattttcaattctgatagatttattatcattagaaaacatacacacatgatttgccctacataaaagtggttcaaatgatgttcaaatatcacttgcagtactagcaatgcatatgttactatatttttcaaaaaattatagtttaatctcatgattttttttaaatacaaaagtcttatttgccacatagcgaaataagcaataacagttgctattgcagctcctgatggtcccaattttggtattaatataatgttcaatatggtatttattaccgcagataatatagttgttgttgctataatgtgtgttgacctagccgctgaaaaaatactaccaataaaggctgttaaagtattaaacatagttgctataacaagaatagatgaatatctccaagcaataaaaaaatcatctgaatataaaaagcgtgccaacggaatattcattataattatcattgaacatcctacagccataactgctccataaacattatatgtttttgagaaaaaaccatctttatcttctggatcaaactctttgattgctgataaattccatgcctggcaaaacacaattatacatgtatctaatatatgaggaatttttcccgcaactgaatatattccagtttcagcagtaccacatatacctgttacaaaatatttatctaatgatccattaatccataaagctatattattaaaaattagtggcatacaatatttcaacatacctatctgggttgccttttccaacttagagaaaaacatctgacgaattgttttcttagctgcaaaaatacaatatattgatgcaacaattggccccgtaaccattgatataagatagcccaggattcctacctttatcactactaggaataaaatattgcttcctattattacccccgaagatatcacacctgaaaccgctactgctgatactttatctatacctcttaaataatttgtcattatttgataaaaagcagaagaaacaaaaaacaagaatataaaaacataataaatcacaggccaattagatagttccacataacaggccaaacctaatagtaaagcacatataatagttccagtaaatagcacctttatgccaaatgaaagtatcttttcactatcttcgaccttttcgattgaaaaacgtaataccgaatcagctatattaaccgttaagatatatataagtaatattcccgttgtattaataagatctgcagtaccatactctgtcgttgttagaacagcggtatatattggtataaataaaaaagaaagaattttggtactaaatgaacttacagcaaatatggctgtatttttatataaatatctatacttatttgctgtgtctttcattcatattcctccttatttagttaagtgtttttccacgtctttcaaggatttttagtgtcatatctcagatgctttcttctccgataactgattcggccctcactgttatgtttgcccaaaatatttgatatgattgaatagcctgccagtttcttcagctttctggtgttatcctaacgactgatatcacctatgtctgctacaaatcggctgactgaaagcataccaattctcttattcgacactatcttatcaagatacaaaaccgttttcagtgtattggttatcttctgcaagattacctccaacctaagttcatacacatctatggcattaacaaattcctttaactctattagtgcagtctccgatgcttccttgtttccaacgctgaacttcgctaccatgattaggttctttgccctcttctttccggcacctctcagtcttgctttcctcggagtctagttcacctctcttctacaaagtataaatcccggtcggtagctcctggtataatattaaacgctttaagagtattgttttatattgtccttcctaagatttttttaatcttaaaatatctttgtacaccaattaatgctacaattcgtcgttttaatcgttcttttcctcctgcccaggaagcactataatgatgaattgaaatagtttcttcacataacaaattttttgtcctgcctgtcgatataggatccatgtattgagatggataaactgttactcctggcaaaaaggacacctcacacaaactaaattctcccagagagcttatagcttctgtatttagtttcggacattctatatcaattcgcttctcgttatcaaataatacgtgctcatatacatcaagcatcttttttactacattgctatgtttttctgctccaaatcctaaacctgtattgcatctatttccattttgttcaattcctatataactctcattagttaaaagagaatccagtgatttaattaactcaacatcagtatctaaatatatgccaccgtaatcaaatattattttcaatctcgcataatctgatacaaatgcccacgcttctgattcatatgccgctcttataaacgggtgtgtagaaacgtcaaagttagattcattccaaagcttaatttgataatctggacaatatttcttccaggagtccatatatttttttaagttaccaggaatctccttctctccaaaccagcagtaatgtattattttaggaatcatataaaccggcctccgtttaattatcgattatctttctacgaaagttttttactctaaaataaaaattatgaaactttcttctagagatataatatggagccaaaaatgttctatattcatgtaatgcatcaatggtacacacatcctgtatttgactataagtatgtgttttagacatgttatctaatccaaaagaatctacggtatactcgtctacaactgtgcctatccaatcgtttttatctaaatcaatttttagcaatctcattttttcgccataagaatttaaattatactgaaccggcctgaaatatgttccatctttttcaaatatttttccagccggcctataaatattatcatttttacttatactatacacatcacttatttttagttcatctatatcgagtatatatacttttgttatatattctccgagtttttgaaaatatgtaagcaaatataatcttgatttatactcaaaaaccgttgtatcaacgcactcaatatcatataataatacctttacaatttcccacttttctaacgaatcgtccaatgctctatataattcaagggtacgattctgagaagattcgggaatcatataaacaacattatcatattgaaaaacacatggatatgaaagatgataagactttctgatgatttctttaggttctgtaaattctccatcaacaagtttcgagactgctaggcttccaacttgtctgtttttttgaaatgcttcagtgaacagatatataccatccttgtattcgaacaatattggatctgcataccaatatcctctttttgtttttaaatttctccagtttgattcttttattttataaaaaacacaccactcaccatactgagtcgtaaatatactcttaatgttcataaaactactctcaccttttattagtaatctctgaatataaattttttagtatattagcacaaacttttgaatcataattattagccttcaattgcaatatactttcgtccgagtatttttctctatttttttctattttttttggtaatttttcaacccaaaatcttgttcctttatcaagtggcaacatggttacaatatcagttacgataatatctttatctattgtatttgaaataaagcagggtaatccagaagcttgcgcttctaatacagataaaggcattccttcccataaagatggaaaagcaaacatatcaaatgctgaaagatactcattaacattagatttcattccagcaaatataacatcatcatttatgccgagttcttcaacatattgttctatctcttcacgcattattccatcaccaactaataatagttttgaattatgtataaaatcatgataatccttaaaaatatcaatcaaaaatttgtgattcttaggctgatatatttttcctacatgaccaatacaaatgcagttgttatctatcccatattgatgccttattcttttcctgctttcaccattaaatctatatttttctgtatctatactattgtttaatatctgatagtttttatcattaaataaccaatctccggctttttgagaacatgctatgccatgtgtatataatttgctgaatattggtttaaaaaaacagctggcaatataatgattacatttttctgtgtgattttgaactattcttaattttacccctgccaactttgctgcaattaattctattgcagctgtggcactattagaatgaatgtggataatatcatatgattttaaaacagtctttaattgatacatatatttgattggtaatctatttctaccacaaatcctaatatattcaattcccttatctttgcattcgtcaagtaaatcattctccggtatattgcctgagacaatgctgattttaaactctgatatatccatttgacgcaggcaattcatcacaacacctgaaagaccgccgtattttgtaaatcctgttgtaattacaattaagagctttcgtttcaccttttcatacctatctcacataatatttctatattccgttctgtccataataaacattaggccatgttttcttatgataatacttatgaagcacgcacagcattatctcgtatctttggttaaacataaatgtgctttaaatccatctctgttaccttttccattactatagcgtgtatagatgcattggcatgactctgtcattaagcaaatattccatgattctttacggctattcctgaaatttccagtggattataccttttttcctctataagctcaaaaattaatttcacaatattggcctcatatgcctcttcaatatcttcattagcaagtacccttgcacacaggatataatccacatgagttgttcctaattcagtcatattcatgcatgacagctgcatttactgaatgctatactaccgtatatggcacctggcggcttggttactatatatttttatcttctgagatattagaaacataaccccaagtataggtaagaatggccttggttatcagattaaggttcgtttcacaaacttgtttttttaatccttttcgtatttttgaacctatcaatatctattgcataaatctcatccaaacctttcttcggttcccatccaagtgctcttaatttgcaacaatcctgaactaaagttcgatgtggcaaaaatccatctgatttcttaacattattatggtcaaaaattattttgatattgggattaaatttttcaaataagtggtttgccaactctttaatagtgataaaagtttctggatttgatgcattgtatgcttctcctgctgtgcctttaaatagaacagtaaatattgcagttaccgcatctaaagaatatatcatacatttttttgtcataccatctgatttcatcacgaaatccttatcctcaataatacatcgtagcaattcatttactactcttggttcatcgtatctttgaaacaagccgtgtataactgttggcctgattattttgacatttaatccatattcagcagtagaagcgtgacacaaaaattctgatgcctttttacctaaaggataacagtttctgaggttcaaactatcaatagcaccaaccatgtcctcagtcatagccggggagttatccgcaggtaaaccataaacttcttcagaggataaataaatcatctccactccttcgtttaacttggccaaatcaagcattttctcaatcccgtctacattggttctaaatgtttcaacaggatgctgcatgtgatatcgatttccagtaggtgaagcagcatgaattatatagtcaatgtgttcttttaaatttaattctgtaccatattggcaatacataatattatcaccctctgtaatgtaatctggtatttctaaaggattacgtgttgagccaataatacgcgtattggtgcctttaatttcgttctgtactaatatccactttactagcgatgttccaactaatccttttgaaccggtaattaatattgtcttattgtataggaacttatcaaaatcgttatcttttatatattttgataactctctatactctacatcagtgtacctcatgctttttcgccccttacattcgctaatatatcttgtaccacttgactcggaagtaacctattatctatcataagtttttccggtgcgaatctgtttggaatgttcatggaaaatcctttattcattactttcatatgagataatccatagtattgtgcaatctttgctccaaatcctccatttaaaattccatcttcaagggtcacaactagttcatgtgtattctttaatgaatctaatgtttcgttatctattccagaaatgaacattggattaattaatgttgctttaatgccatggtttgctaatatatctacaatttcttctcctaactgataaaagctgcctaatgcaataatagcaactttagaaccacttcgagtgacctcatattttgtgtcaaaatattcatttctaaattctttgtatacatgataaactttagtccatggaattctaattgcaacaggaattttatcctgattaatgctccagtctagcattgaaatatattcttcacaatttgtaggtgccaaatatacaagattcggaatattcgcaagtagtgcaatatcatacagtccagcatgggtatcattcgtatgcccccaaactgatgcatgagttaaaagcattgttgctggacattttgaaatacacatttcctgctcaatttgatcatatgctctttgataaaatgtgctattcgtcgcaaagactggctttccacctctttttgcaattgccgctgtcatcgatatagcattttgttcagctatacctacatcgataaattgctttcctgctttatgtcttctttctgaattaaaacctatgcagagtggagttgatgcagcaacaactatcacatctttatcatctttcatttttcctaataaatgctcacctataattgcgccataattttctttaggaatccctcctatatactgtcctgtttctatatcaaagggacgtgcccaatgccatttttcactatcttgctctgcgaatgaatatccttttcctttttttgtacaacaatgtattactacaggatggtctattcctttaatatcttcaaatatatcaattaaattttttatatcgtgtccatttttaatgaatttatattcaaatcctagagatttgaaataattattttctatgacaccgttgtactctctcaattgattaagtgaatcatgtaagccaccatagttttcaggaattgacatgttattatcattcactacaacaattagcccactatgaagttcttttgcataatttaatgcttcaaatgcttctccgccatctaacgaagcatctccaattacagcaattatattttcattttcacccttcaaatctcttgccttcgccatgccgcatgccagactaatagaagttgatgtatgaccgatgttaaaaaaatcatgcgcactttcctctgggttactgtagccagacacatcatcgtatttatcttcatacaaaaacgcatcttttctacctgttaatatcttatgaacataggattgatgtgaaacatcaaatataattttgtccacaggagaatcgaaaactctatgtaaggctatagtaatttctacaattcccagattagaggccatatgtccaccaagtttactcattttttttatcaaagcagacctgatttcagaggaaagaatatttaattctgtaactgataattttttcaaatcatctttgccgttaactttttcaattatcattttccatctccttatttccaattgggattcattattggtgtttgtttaatttcttttccttcctcaagctctcttatttgctgaaccctaggtgtatgatgttgaccgataaactctgttgtcaaaaaaatatccacgcgatgttcaacatcttcatatcccatgtgtttttgtccaaatgcaatcatgtttgcatcattatgttgcctcatgtattttgttacaagatccgcatatcccatgccgcataaaattcctttgattttatttgcagccataatcatcccagtacctgtagcacataataatactccatatttacaatcacctgaagcaactaaccttgccgcttttgctgcaaaaacaggtgtatcgcaaggaacattattgtatgtgccgacatctactggctcatacccatttttttgcagatgggaaattaacctcagtttataatccaatccgtttctatcgctagctaataccactcgcattttttcaccgttactttctcatccaatctggtctagttgtttccaataatgccgaaaaaatctccatatcctcagatgttgtgagtttaatgtttttttctgaaccaatggaaagatacaatttttttcccaattctacatataacgaacatgaagcaattgaatcattaattcccttttcaattgcctctttatgcgctttaagaatatcattcaaaaaaaacgtttgaggtgtctgtgttattttaagattgtccctcggaatttggctattcgatgtcacactatcagctgtcttaagcatcacagcggtacaaggaataactgtaattgcatttccatattctctacataccctaatgttatccgatataatatcctggcttaccattggccttatagcatcgtgaattaaaacaatatcatcatcggaagtatatttcttagctatatcattcaatccattcctaatagattgtaagccagtttcaccgccggatactatattttcaagttttgttattccgaactgtttagaatatgcacgcagaatatcatgccaaccatcaagacaaaccacttcgattgcatcaatatatggatgcttttgaaaagcttccaaagtatacataatgactggcttgtctttaacattaataaactgttttggaatatcttgatgcatccttgcaccaaccccacctgcaataattaaagctatgtttttcatgttcattcctctatataaatatttgcaatttttaaagttcgtttacactgttgtccgtcgttatatgtgttaacaatcatattaacttttcttctaacatctgcatataaatccatgttgttcaaaagatcttttaaaaaaccgtaaaactgtaatttgttttttattttatatcccgctgtgaggtagtctggattttctacagcaaatccccttccttctttatagccttcaatgtcatcaacagtaaatgcaataggcctatccaacaacataaagtcataaaacactgaagaataatctgtaatcatcgcatcacattgtgctattaatttatacaaattccattttttagaaataaattcagaatgactcagcaagaataagttacttaaattcatactttcaaaatcagaaatatcctccatcggatgcaacttaataattaataatatattactttttttaagccattcatttaagttaatataatcagatgtgtgaaatattggagtaaaagattctatttctttaatatctgcataacctaatgtttttgactttctaaaagtcggcatccatataaccacctttttgtagccacttagttctggatatttttcaaattgtctaaacataatatctgttctaggctgtccgcatattactatgttctcatctttcacaccttgagcccttttcacaacttctttaaaatagtctgatgagattagcatacttgtgtaatatgattttcttgaaactgtttgtaattggcgcttatcaggagccttaaatggtgtgccatgccacatttgtacaacatattgattttttgacggataaattggtattcttccaaacgcataaaaaacatgtccagctctaagatagtctatcacgccatttaaagtatttatgtagtgcacatttaggggaagtctctctgttattttctcatttgaactaatcaatatcttatatgttgaattatattcattttcaattaaataatcgtaaatagcttttatattatccctaaatcccatatttgtatacagtaatatagttttatcatctttgggaataaccttgttcaatacggacaaaaggcgaaaaattgtattcgttaatatatatttagtcaattcattttttatcattttacttataccttttattactttagtagatatgtctgtattgtggcaatactctgacgattatacattaaaacttatttcactccgatttttctaggatttatatagtaaatgtgccgacttttataactattataagaattaaatcatcatatcaccaacaatcttttccaattcttcacagaatttcgcattattactgttcattccatgtctcataccagcaatgagctgattataattagttataatttctcctagattcgcaatctcttctaccagaatgattgtacccatttttcgtgctacattacgagcgaactcaacctgatgattattcacatgttcaccaaactgatgctgccgaggcacaactatcggtgttttaccaacctgcaatggcataataaaacttgcaggacctccatgtgtaatcacaattttggcatcagccacattttttatcatctgttgatatggaattaatttgctacattgacaatactttggtttataggtactaaaaccggtctgtatgataacttcgtcggttattactccatccttttttaaatcatctactgccttcacaagcctgttaaatggctgttcatgcgttccaactgacacgaatatcatcttctgctcccatcaaaaaatactaccgaggttgattgcttttggatatacttttttctgttcatcccattgaactatgaatttatctacaattggataaaccatctttcctgtcattgttggcttgtcaatacgatcaaagacttcgatataaatcagctttgctcccattagtttaccgatatagaaaaacggaaccgcaaccgcggcaccagaagagataattaaatccggcttttctttatacaataccttacaggctataacggtattcattaacaaagccttaaggctacggtttgttggataatagcaggtataaaatttcttcccttccaacaaacttctggcatcctctttatcaaaagttacccagaaatgttctttattcttccaaaaaggtttcagcatatacagatgcgttaaatgtcctccagatgagcccactaaacaaatctttaatttttttttatctgctatatgattcatcacttataaactcccactttcacaattattgaacatatacggtgattatctgttagcttttgaatgcgccaatatgactttcaaaatttgcatctcagcaagttaggacatctcgtaacattcatcatactctttggggtgtgtgaaagagttatgatttccgcaagattgtattttttagtgtttaataacactatacaagcgtcaatagatgacaaattctatattgacaacaaacaaatcatcatttatccttaagtacgacaaatagcccgtaacaaagtgggtttacttcacgcaagcttaaccaaattccttctaaatctctattcccaaagatgttttcagacacgacatggtttggggtctgaatatttttcctcaaaaacaaaagacattctgtcgcttgtaattcatcaatttttagaggaagcacccttttgacctattggagacgaaacttttaaaaaatttagtccggctaccaactccttatatttacaaggcattttctgctttaatcacatagcatattactagccatatgaatacacaaatacttgtccacctaattactgtattttggctaaaaaaactggcgaatggcccgattcggcagtcttgtatatataatattggatgttcaatttatttctgttcaagagcaattacatcataataaattacttaaatgaacctaatttttggtactctcaattgaggaccttgaacattatgatattcaaattctccattttccgtatctttacaagcaatatgtgtacataaattctataaatcatctccaaataattgctattattttgaccttaactaattaaactgcccatcataccttcctatttctaataccttatctcctatctccataatccagttcagtatagcacgttctttttcaaacttcaacacattcaacacatacttaagatatatttaattggatttctcggatagtcctgggtcagcagccaatcctttcctcgatagctgtctgtaaatgatttttataaatccaaaaagatttactcctctgtcctattagcaaataactctatattatacggatagctcactgccttttaatatcatacagtacttctttgtatccactcttactaatcacgaaaacctacaatttttagaatctttccccaaatagttttaaccacctcgctcacaaccatttcctttaataccaacaataccccgccatatatgatgaaatatcctccgaatgaaacggccagtaacggaaacaatgttaaatttatgttatctcgcacaaatatcaaaaacacggcagatataaatacagccacaccaattttagcaatctggactttctttataatcatcaatgccgctgtttttaaagcggcgatttgtactcccaacaccaccaattcagcaataagagtaccaacggctgctcccgctgccccatactgcggaatgagtatggcatttaaaatgatgtctacgatggcccccgtaccttcagaataaagtaccacctgctcttttcccaacggaaccaacatctgaatgccaaatacattgcttgccccaataaagacaagagtcggcatgattatacacataggcagaacagatggcaaatatgcttcacctgagagcagcagaatacactgttttgacatgacaatgaaaccaatggccaaggggatggataaagcggtaacaaactccagcgcctttgcagagactgcccaaaattctttctccattttcttttctacataataagatgtccgtggaagcagtacagccccaagcgaggtaaccacattaaccagtattaccttgattttaattgccacatcatagtaccctacctctgtattatctctcatgaatcccagcatggtaatatctagattggaataaattgttactgctaccgacatggcaaagaaaaccaatacaggtcttaaatgcctttttatattataggaaaaaaagtgttcaaatgttatgtgcctttttaaatttataaagttaaatatgccatatcctgtattagccagcacggttattccagcatatattacataatcatccttctttttgaccaacagaaacataagtattacagccaggactttaaatgccaaagagcgaatcgtaatatatgaataacattctaatgccttatacaaccattccattgcaatcatgttcaaaaaaagggacatactgcagactaacatcaggatacgttcttcttttaatcgcgggacacaaaacagtgcaactaaaaaaatcagataggctattaaggtcgtaacagcattgattatccaaatttcctgaacagtctttgaaagctgctttttatcatctcttacctgggcacaagcacgaattccataagtaggaattcccagcaaagcaaacatcgaaaaataagtaataatggaattggcaaaagctatctttccatttccctctggctgaagcactctggaaatataagggaatgtaatcaatggaaatacaaaagccgatgttgtaagaagcatattcattatcaaattaaactttatagacttctttccgcttttcataagtctctattcacctaatttccatccaggcctatacacctcatgcagaccaaatttaccattcctggcatcttccaaaccgcaccgtaacatttccctctctgctttatccatgttaaaaagaaaatataattttaccttaatcattgctttcatataaaaaaacagaaaacaccttttaggaaaatttctgcgataacaatctgtcatatttctatatctatagtagtagcgccaatctattgtcccattgctgcttttatttacatcgtggtgtattcttatattagggatacacactatttttcccaacttccccattctaagtccatgctctgtatcatcaaaccatataaaatattctttcctggtcaatccggctttcaccatctttttctgatttatgattgttcctacataagaaaatgtattgatttgaaaggtttcctgctcatacattttctgaggaggtacccattctttaatacttatccccttaatatataaactccttctatgctctaaatccgcctgtccttgattgataacctgaccacatatggctgagatattttcccattcatttctatgaattgtcagatacttttgagctatttcaagtgcatctgtttccggaaaagcatcgtcatctgacacccaaatccattgcgcgttaagtttcagactttcctgcagccctgtataaaagcctccgctccctcctatgttctgattcatgcggataactcttttcatgtatttctttttatcattttcccatttgctcaaatacactggcgtttcatccgagcttgcgttatctaccactacaacatatgcaggaggaattgactgcatatcaaaagccagcaatgcagtcttcaatttctcaactcgattaaatgtaacgataactactcctatatccattaatcctttactcattctctctttcctttaattccagccctgaaatcccacagcccccatccaacgtatcttatatccatataccctttcaaacaataatacccgtacatggcaaggctatgcatatatgccctaatgcggttcacccctctggcatactcacttataaatatcattttatttcgtaccatatagtactgtgtcaatggagaggccttttcaccccctccggtacttgaactaaccttatgatagacaatcgactgtggtgcatagtatatcttccatcccgattgaatcacccgatagcaaaactccgtatcttcttcatataaaaaaaaatgttcatccaaaaaaccaattgattgtaataattcagcttttatacacatacagcatccagttgaaaaagtgacctcttttatagcagcaggtacatgatattcagtatttccatgtccaagcatagtaactttaaacgtattctgattgaattctccccctgcgcaccaaacctttttccggtcattttcataatatatagtggaggttgtcagaccacatctatcgcatacctcaaatggctccagcaatctttcaagaaaatccggctcaacaagcgtatcattattaagtagcactatataatctgcatgatgttcaagagcagattgtatccctatattattccctgctgagaatccattattttcatctgcctccagcatttcaaatcccagctcggcctgacagtctctcagcgcctgaaccgactgattcgaactgtgattatccactacaagcaccagataattatcataagtaagtcttttcaagctattcagacattcaattgtatccttctcaccattataattcaaaagtataattgctgctaaagcatccatttaatttcaatttcactcccgccctcttccatagacctgcttaagtatctcctcactctttttccaggcaaaccgttctgccacatactgccttcctgttactgatagtttcctgcatctgtcactgtctgtcagcaactgcagtatacatgtttcatactcttcatccgtttcagccttaacgacgatttctccctcttcatcaattccttctgctccaatactacctgtaataacaggtgtccctatagccagactgcgaagtaccttcagcttaataccagctcctagagtaagaggaaacacagcagcttgtgcctgctttaaatacgagtcaacatcatctacgaatccagtgacatgtatatagtcgttttccatctgacgcagctgctctggcggctgatttcccacaatataaacctgaagttgcggaatctgttcttttaccctggatgcaatttttattaggcgcatcgctgccagataattttcatcacgtcccatctgtccaaggaaacaaatcatcccttgctttttttccccgccattcagttcctggctaatagtttcatcatccagcccgtaatatggattcagtactttacaatctcctctcccatatcgctcttctataagatttttatccttcttattgaaggtgaacagacagtccacttgtttgcaatattttccttctttcttcagaaccttttttaactgtgaatgcatataaacctttttaatccccttactgtcattcatcttcctctcataggactgtgcagtcatatcatgttctgtcatgttaaatttcagttctggaaacaactttttaatccaataatactgtcccatcgaagcatactcggcatgtattgcatcaatcttatacttcttaaccatatatatcatcacagctgaaaagcgaatagagcttctggctgcaaaataattcggcatccatggttctgccagtatatgcgccatacgccttatacgatttatttttatgcttctacagaacccctcttcccccaactgttttcttaatttactgtcatactccgaagcctcgaatgtaagcacataaaccgtattccactgccttaatgtctcaatctgttttcccatgcatactccgccagcatgatttgcctccaaagatggaaagtaaggggaaatatgcaaaatattcataatttattcctccttttccagaagaggaagtacattcttctccagaaccctttccattgcctcaactgtaaaatactgattatacagtttctgaattagccctctcttctgcagtaacgcatctgtttttaggagtatatctgatgcacattccttgtaggaattccctatacaattaattcctattccgtactgttctaccatttcccatgtgtctccctgaatattattgattatcggaagtccataacaaaaataatcgatggatttcatggtcagacctacacacacacctggcttcattatgttaattccataactacacctgtcgaaaatctcctgttttttggtttcatcatagaccgtcccataatactcagtctctatcccattctgctttaagatttcaagaaatgcctgccgcttctccccatctcctacaatatgaagctttacttttttacttcgattcacctccctcaaaatttctgtaacggcattcatatcaattatattatttacagaccccagataaactacatgcatacaattgtcatccttctgaaatgcccactcactggcccccttatcctttggccaatacagcgttaccgcctcctctggttttaacccaataagtctcttatacaaaccgcattccgtaaacaccaagtccgcctgtcctaaattatcatctctcaaccttctccagcactgaagcggccataatgtccctacaccttttagaggcaatgactccggccacatatctataatatccagaaccacctttgtatgaagaatcttttttaatttaactgcagtacgtgcaagggaattggctggtatcatgacataaagcaaatcaactggctcattcttcaaaacgtgaaataccttccgtgcaaagtcgtactgtgagtacaaacgccggatagataagttttttttatacacaactgtttcaatataacgatgatttgacctgggtaatcttccctttttcttttccctatgaataaagtctgattccagccacaatacattgtaacctaatttttgaaaatattgacctatcttttctgctctgggctcatagctggccgaattagtcacaatcacaatattcatagtgccctgctactccttcacatcctgtttctcggtttcatgttccatggcctctgattcctgggaagaaaatccttctgtactttctttttcaaataggatttttattgttttgaataaaatttcaatatccagaagcagtgagtagttctgaatatacatcaaatccatcttcagtttatcatatgccgttgtattatactttccatagacctgtgcatatccagtcaagcctcccttgaccttcagacgatatgcaaactccggtatactgtcggagtacatattcacatgctcaattcgttcaggtcttggtcctaccaagctcatatcaccttttaagatattcagaagctgcggaagttcatcaattcttacttttcgaataagacgtcctactggggttatacgcggatcatgctctgtcgcaggaattgaagcaccgcctttctcagcatctactatcatactgcggaatttgcatatcatgaaaatctttccatcctttgtgcaacgttcctggtagaaaaacactggtcctctatcataaagtttaatcgcaagtgctgttgccatcagaattggcgaggtcagaatcagcataaacaacgatatccctatatccatggtacgttttataaatgcctgttcaatagacaacccatcatttctggacagcaataaaggagtatcaaaataatgcatactctccgcgcttctgataataatatcggaaatcttcggtgtactgtatactcgaattgatctggcatagcagaactttagaaaatcatttctcatagcagaaggcaaatcacagattactactccttcatatttcaaaatctcctctttgacttcgtcacaactgttctctatctttacacatttccctatctcaaagcaatcctcacgactatatattttattcatcaatgctgttacaggtctttctccatacagcataatcaccttacggggtggatataagcctcggtaaatcctattagccacatatccccataaagcaatcaacacaaactgacctgcagtcatccataccaaaggaaaaaccgagcgaaagtgtttgacaagcaatacaatcggaatatatgatactgcatttgaacacattgttgcaagcgtatgtgtataaatcagttcgccagtcctcaaatagcccaaacgaaggctcccatacatattactaaatacatataaaatcagtgcatatactgctgctaaaaagtaatgtcctaaacgctgatacggcatctccatctgttcgttataacagtaaatccagatatacataaagattagcgattgtattcctatcaaacacatctttgcaacaaatcgaatgagacgtttgtatttatcgtattttttcacttgttgttaccatacttccttacagtattctttttctaaaagtactctaagtataacattctttaaattgcggtgcaacttattctccctatttgcagttatatccagcttatccaattcagatacacaaagaattcttttcaggccctaatactagcttgaaaagaattctctattttaaaacttatataccatcattctgtacagccgcaagtcctaccataataagagtaaacataataggcgctactatagggacgctgatgtttacaaatgcctgcgcacaataacatactactgctattggtacagccattacaataggacaatcttttgccttacggataatgtacactaatgatgtacaaataaagcctacatatgcagtcactcctaccatccctattgtcacgagatattgcaggtattcattgtgagcactatcaaatttctcattatatctgcttatcatatcatcatagtaaccgtgtactgtaataattccaaacgtatccggtccatatccaaaaagtttatgcataaacggaaactttccatatatttcaattgctattctccatatatatcctctatgtgttccccaatcatcgtcaaaaataatataattttttagtgagccatatttctccagattgcccacaatgttagcatcgtaaagaatatagactcctgtcaaaaacattactgctaaaatcaccagccatatccacctaccggcattactctcaattaacttattgcctttaattagaaccgtttccaaaattgttatgagtactgccactgcccacagaaccattacaacaactggaagtttactaaaaccagcgattacattaaacaggccattaatctccataacatgatttggaatattctgaccgatataatcaataaatagaaattctgtactcaaaatcgccagaattataacatagtctctaagacctcgaaggtttttaaaaaggtacaagggcaatagacacagaagggctatcatggccaaatatgcattgtcactaattccagtaatcattgcaaatatggatatcgacattgctaaagcatataataactttttaaatttatttctttctacgcaaaacagaagcgtactcgctcccataatcagagatacataggacgtataagtattgatattaccaatagtggacacaaatatcttatagtcttctggggataggtcctgtttaaagccaattggatccagtttaaaataatgaagtataccaacgaggcatgtcagtataccagctaccacaaatgcatcaaaataccatcgcctgaactttaggcatttggtgattataaaatagctggcagcatataacaaaatcaaaaatagacctgaatatcttccctcattaccccagaaagattcatagaaatattccgactgaaaggttgatatcacagcagacactacaaataatatcattgcccaatcagctacttttaaggattttctcgtaaatccatgccgtaatgcctttattgtaccatagtcattctctataccatccttacgaataaatacgacagcaataatcagtatcacaatagtcatcgatataactgtaccacaatatagccagtatttaatcgccaatatgtcaaaatacaaatcatgaaatgccaatggcaatgccacaaaaactatcaatgtcaggattaatgcaggaatagaatttgcatttttccaagattgtaatatatccgattgtctatctatacttttatcttccttcatcatatgcttactttcgctttctgtgtagtttgaggtttttaatagtatatcattttacccctatttgtgcaactttatgaatagagatttcaccaggtcatccctattatgtagtagtatatgctatatagcaataattttccatatacgaagtataatcaactcgtaatgcaaaaaggaatttcaaagagtatttcaaaaagaaaaaggagagtgcattaattatgagaaagcagacaaagttagttgctgtattatcaacagcagcactgctcgctattggtgcatccatgacttctttcgcagctacaggatgggctgaggaagacggtacttgggtatattacaacagagatggcgagagagcaactgatcagtggaagaaatccggtaataactggtattggctggatagcaatggcgaaatggctattgatcagattattgaagacagtgacaactattattatgtagacatcaacggtgttatggcagcaaaccagtgggtagccattgacaacgaggatgcaggacaggatgacgagccagatcattactggtactatttccagtctaatggtaaagcattaaagaatggagataacagcaaagttgcattaaagacagttaacggcaagaagtatgcctttgacgaagaaggtaagatgctgtttggctgggtagcagaagataatgctgagcgcattgataataccgacggcgatggcttcaaggaaggtgattactacttcggcggcgaagatgacggcgcaatgaccgttggctggttagaaatggacatcacttatgacgaggctactaatgactacacaaagtctccagtatttaacgatgatgaggatcagacacgttggttctacttcaaagctaatggtaagaaaatcaaagctgagggcggagatgaattaaaagaaaagaccatcaatggcaaaaagtattcttttgatgagtatggcgctatgacagcagagtggtctctggatgtagacaatatcagaaagaaagcaagtacctctgatcctattcctgcttctaatagtacacctaccaccaacagtgttgctgctaaatatgcacagcagtggagatacttcagcagcgttgaagatggtgctaaggttaagaaaggctggtttaaggttgttgcagccgagtacctgaattacgataagtacaatgatgatgaagacgcttggtactatgcagatggaagcggtaatctgtatgccggcgaattcaagaccatcaagggtaaaaagtacgctttcagaaatgatggccgtatgattgatggtttgaaattcatcagagaagacaagactgctggtaaggtaacaggactgtcagtatgggctgatgatgatgatccatatagatttgatacagaagatgacttcgatgagaactccttaacattagagcgtatgggttacaagtgctactacttcggaaacggagatgacggcgctatgaagaccaataagacaaccgttgagattgatggagataaattcaacttctacttcgagaagtccggcggaaacaagggtgctggtaagactggtgataaggatgataagttctatcagtctggcaaattgttacgtgcaggctctgatgagaagtatcaggtagttgaaaaattaactcaggcaacactggatgacactggcaaggctggcagcggtactattgagggatataataagttagacgatgttaaggaattccttgaggcaatcacaccagctaactacagcgagggtgtaactgaggcaaatgtaaaactcttaaagggtcttggtgtaaacaaggatgccagcgacctcagcgaactttacatcatcaactatgatagaaaagacgctgctggtaagagagaagcagatgctattagtgcaagtgattacttcctggtaaatacctccggtaaggtaattgatactaattctaagaataaggatggcaatgattactactacgtagttcagaagaatggtaagactggcaagattgttgctgtttatgttgaggattaatattttaaaaagtaattcttaatttataagggggaagcgttgtgactgattagtttatatggtcacaacgctttctttttacaataaacatgaaatcatatgaaagaggagaataatacttatgctaaaaaaggcttttttggcgacaagtcttttgttatctttgactttgttgcaaccacttacttcatttgcagatacacaagataccacttctgcgactaccatggaaaattgcggagcctatctgtttgagtggcgccccgtagactgcggtaatggacattattttgccatattagtaggcggagatacccttgaagagcggaacgtaatacttaatagaggatatgattatgcgtatacttttaatcctatggcttatccacggccatggggcacagtacccgaattggtcaatatcgatggactttgggggattccagaaaattgggcacttatgccggaaggtagccaacaaacaactcagattgttttgctgacgaataaaaccacatttgcaacaaaagaacgctacgttgatgttgtaagactaccacgaagtgtatcatcagcagatttacctcctgaagtacgaaaatacttaatcaatgtagatggaacagatgctggggcatatgataatgcaacaccagcaggttggacctggaatgaagagggattttggcgctaccggaaaccggacggaacctttgtaagcaatggatggttaaatattgatgagcagtcatactatctggacgaaaatggtcatatgcttgcagatacaattacacctgatggattttatgtgaatacaaaaggagagaagcaaaggtacacccctggttggatgcaaggtgagaaaggctggagatacgtccaaaagaatggatattatgctgcatctacctggttggaagatacagatggcaaatggtactattttgatatgagtggatatatgagtgtaaacgagacaacacctgatggcttccatgttggcgaagatggttcttgggatggccagccttccagcatagaataccaaaaaaatctcggtcctggatatcagcagcaagccgaagctgaagaataattaatttatcgcgagtgtatgaaattttttctgtaaataggtattagccaaaggtcttctatgataaaataaaaaatcataggaggccttttattatggcaagagaaaagaaaccggtacaccaggtacaaatgacagatcatcactcacctttcctgctgattcttctttagttagggataaaataaaaaacggctccttcgaagtttctttcgtaagagtcgtcattgaggtttgaatggtatagttatattttaattttgatattttacttgttttttgatgtttgttattattatcagaaaattataaatacattttatagcaacaaacgcaataattcaacaaatatgtacgttcagcgtcatttcatgctcaaaataaatagatatatctaaatatctagtcgaattataaaaaagcgaaaaataatgtgaattttgtcatatatattacagattttttcccaatttgcatattattattatccttttatgccattattgatttggttacctatgccatttccgtaaacgcctaatacacgtaccttcttatcatcattctttgagataataggcccaacatcaaaatccaaaatagtttagtccaaaaagtagacttgacttttgatacacacaataaacagagggaaatttaatggaacgttgaaactcactcctaaggaagtccattcaaaattgatatctcatgagttatcatccgcctgctttttgggtggaaattcacggcggctattgcgtatttaagtatgcagaatgaagtttcaatgccatctgaggtgatatatttccttgattgcttccgcacggaattcgttttcgagaagatttgttatgatgttctcataggtgtccccgatggggaaacggagaacacggagggagatttcgtattctccgtacccttcatccgggaaatagtcaaaagctacctcttggcagatatatcgggtccttttacgaatagcccaaaatccgtggttcaggggcaaacatcctctgtctgcatgcaccgaataactactactttcaagggcagttctctgaacagtaccaggatctttgggcagccggtacaaatgcggaataacgcatccgttccaaaggaacagatgcgcacagattgtagtcaaagtccgaggcacacgcctcggatttttctttaaaaaaaccttaaagtctcttgtttaggggattttatagctcttttctgatttaatgcaaatataaaaagaaggcgagatatttctatgatgactcagaatacggacaaaaaaagaggacagatccagatgttctgtatggatgacatggttccccaggaccatcttctgcagatgattgataaagcgattaactggaacttcatctatgaccttgtagcggacaggtacagtcctgataatggccgccccagcatggccccccagtcatgcgataaaactgccattcatccagtacctgtatggcatcaaaagcatgcaacagaccgtaaaggacaaaaggaccatcagggaaccaccctcacgaaagcagaggcgatagaaaagataaaatcaggagccttccgtcatgtgataacagaaatcgggaagctctcacccaagagctatctcacaaaatatgtcacggtcttaatatggcaccgaccatcactgaacttcatatccacacagatgaatccggaagaattaacgttccgcctgaatatcgcagtaatgccacctatggccctgctgtaaaagcgctggaggtagaactatatagtgaaggagtgatatctaatgaccggatcgcagcatttctgaatgcggccggccatggtcagcttggtctttctgagagaatcgtctaccgtttctgtaaccctgctaaggggaatgaaccaggaacggaacgagtagattgcccggggaatggtggaatttccagtgaacaagattgccgcttttgagaaaatctatcaagaattgttcagcaagggaagaaagcagaatagtgagacaaagcccggttatgccaaaaaagatgaaaagacgcatctgaaccgaatggaaaaatatcgacaaaaccatctattgttcctgcttgaatttgcggtgccatttggcaacaatatgagcgataaagatttgcgcaaagcgaaaccgcccaaaaatggcaagggaattccgcaaggatagcggggatgaaatgtactgctcgatattgagtatgatagagacactaaaaagaagagatatggagatgttggaacatataaaacggctattcaccggcacaccggctattttttagccagtgctaaacccgttagttcagccggaaggctgaactgttacggcagacgccggaagggttctatttctttctgcgcctgccttttccatccctatttcattgcatcctccatgacccgaagtacattcaaatagaacacctgatcaatttcctgtgatgtaaatcccctcttgcgtaatgcgttttccagaacgcctaggcctgcacagtcctttatctccaggttcccttcgattccatcgaagtctgttccaattgccacacactgaaccccacccttgttcttcatgtaggctgcgtgttccgcaatcaactcaactgtactgtccggacattggatatcagcgttcaggaattccgggccaaagttcagtccggctactccgcctctttccccaagggtatatatcatagcatccgtcaggttcctttgatgaggacaaaggcttctggcattggaatgggatgctatgaaaggtttatggcatatgtctgccacatcatagaatccaccgtcagacagatgtgatacgtctaccagcatccccaaatcctgcatgtactgcactgcctccttcccaaattccgtaaggccgcgttccataatggaaggttctttactattagggaacccaaaacagttgacagcgttccacgtaagattcatggcccgaactcccatatcatagtaccgcttgacattctccaacctaccatccacagcccgtccatcttccatggatagaatagccgacatcctgccagactgatagttcttcatcacttcgtccgcgttggccgctggcccaatcaattcttcatgtttctgtagattggtacaataatagtcatataaggtctgtatatactcttcatctgaaacgggccttataccatgcatatcataccggtcgctcggtatcacaaaaatcgcaaagaactgggccatcacatttccagccgccatgcgtttgaagtcaactgcggtatatttactgtcatacaaatccgcatagtcagggtcctcataaaacaacgtcatcaatgagtcacaatgcatatcaataaatggcatttttatccctccgatacctattaggcctatttcctcagcgcaacacattcgatctctaccaatccacctaatggcaacttcgctacctgcacgcagcttctggctggatatgtatcagagaaataacttccataaatttcattgacagttgcaaagtcatccaagttctggacgaaaaccgttgtcttaagtatatcgctgtagtcagcccctgcttctgccagaacagcaccaacattcttcattgcagcatgggcctgtcccttaactccttctgccagttttcctgtttccacatctatacctagctggcctgaagtgaataccaaagtatctgtataccatccctgcgcataaggcccgattgcggccggtgcatttgtggtgttgattatattcttcatcgtctttatatacctcctgcaactgttatattttatttacggtaaagcctgtttttgcataaatcaaatcaataaccggtgtaatccaattcaagaaacaatatggaatgaatgccaatggagctacccccagcatttgtgaagcgtatatggcatttgaattccatggaatcagtactgcaccaaaggtgcctgcgtcttccaatgtccgtgaaaggttctccggtgcgatgtggttttcactaaaaatatccttcatcaatgtagccgtcacgatggaggcaaacagcattgaagaacctatggcattggtaacataagtcaacaccgctgtgcatgcgataattttaaatgtagaattcccgcatttcttaatcagtggatttacaagtacactgaggacacctgtcttatccagcattcccgatatgcagagtgccaggaagattgccaggaatgcactcatcatactcatgattcccccccggttcagcaggatatccacaaaggagctgcctgtatcgatgacaaaaccatttaccatataatccaacagcttgccaaggactacattctggtgcaggactgccacaaacattcctgaaacagtgccaatcatcagggctataatggaaggggtatttgccaccaggagcaccaacacaattccgatgggaaagaactctagtagggaaaaattataaaactgcgagaatgtcgccatgatttcatttgcagtacttgtattataaactcctgaaacatgatgcaggccaagaatcacaaacaggattgcggtgatggcatatgccggggccgttgtccatagcatatgtttcacatgggtcatcacatcggtccccgatacagaagcagccagtatggtgctatctgaaagaggtgacatcttatccccaaaatatgcgccgcagataatggctcctgccgtcatgggtgatggaattcccatagcatttcctatgccaatcagtgccaaccccacagtccccagggttccccaggaagtacctgttgccaacgatgtgaaggaggacaaaatcaatgcggacagcagaaaaattttaggtgaaatgaacttaagtcccatatatatgaccattggaatggtcccgctggcaatccagaccgcaatcatcgcgcctatgacaatcagcaccacattgggctcaaatgatgccgtagccatctcccaggccatttcctgtaattccccgtatttatatcccagacgcatcaacagcggagccacaacaatccaggacaataaaaacatcaattccagcggggcgtcaaataatatcaatcccactgccacaaatccaaatacgcatcccgttactaaggcagcatatcctatggaaaccggatacttaaaattcttagatagtaatttatcattctccgccatttcctctgcctcagaaatctttatctctttatctgccattacccatactccttttccggcaggcagtcccccctggtgctgcctgccggtagtaacattttttatttaggtcgtttctcactggccttcttcatgcattccagggccttttccagaaccgcggtctgggtggctacattaaggcgtatgaagcccataccaggctttccatagttagctccgttattgagcttcacacccgcatcctggaacagatgcaccagctcaaacggagtcaggttccaggcccggaaatcaatccataacagatacgttgcttcaggttcaatcacctttacctcaggcatgttctcagcaatgaatgacttaacaagctcaatattctttttgaaatattcattctgctgctccacatagtattcacactcattataggatgcaataagagcctcaatccccatataattataatcgaaatgataattatcgtatactacattgtactggtccctcagcgccttatttttaatcactacatatgcggagtaaaagcatgccaggttaaaggtcttactaggtgaacccataacaattacattgtctccaacctcttcggaaagcgaaaaatacgggatatgcttatgaggcgcatacacaatatccccatgaatctcatcactgacgataagcgtatcgttctttttacagatttcatacatgcgcataagctcatccctggtccacacgcgtcctaccggatttgccggattgcagactaaaagaatgcgtacttttgggtcggaggtctttttatccaaatcgtcaaaatcaatttcatagtggccatcgtttaaaataaggtcattgcattccacgaatcttccggctccctggataacaacgttgaacgtattatataccggaggctgaagcaggattttatctcctggccgggtatatgcgttcagaatcatccaaagcgccccagtcatcaacccctgtgaatggcggaccgcttccggttccacctcaataccataccgcttctgataccagccgcacacggcatccgcaaaacgtctctgaggaagatatccatatgcaaacacaccgaaatccaccctttcgcggacagcatcaattaccggctgcggcgccttgaaatcagtatcggcaactcctaagggtatatattttccactctccccctcataatcccacttaaaagaatccgtgttcacccgattgattggttcatcaaaattatgtacgtagctcataacatttacccctttcttatttataaaagattaattttctttcatgttctttttcatggatgatagtatgaagcagcatactatacctaatacagcaaacaccatcatggtgataaaaatatagcggtagccctgaattcccggataggcatccataaagtgcccatataatgtaaaaatgaacaaatccggcgtatttcctacgatagagaggataccggctgctgcaccggacatcatgattggaattttgatttcgtctgtagtggaatagtaagtaccgcgtatggtcatcatgactgctgccaacagcaacatgacaccgatgacaattgccagccctgcgttaaccggtatcaacaggtagataccagtcaatattgtgcccagggtaagcgctatcttgaggaaattgatggatgagcccatcttatcagcaatcattccgcctataggtgccgcgataaatgcaagcagatactgacggacgatattgatggcaactccaaggctgacagacattccacatatttcagtcagatacgtagaaaagtagcttaaaccattataaaaggaatagccgaaaaatacaattgctccggcaacccacacgcgtggcatcctggccacatggaccaggccgtccagggcctctttcgcattcactttgccctctacttcattcttttcaatcaggaaataacacgctaccccaagcacacatagtgatatggcataaaatatcatggtcgcgcggagtcccatcttcccctctccgaaggtggtgaacatccataaagccgcgaatgagatgatggttgctgccagtccacgtccgccctccagcaatccgaacatccttccctgttcttctgccgttccaatcatacgggtcccctttatcatcgcttcccaaaagagcagggttatggtaatacccatgatggcctgtataatgagaacactggtaaacgacgggtacgttgcaagccagaatccgcacaggcccgttgaaatcaatgaaacaggaatcagatattttacaggtacaaggtctgtaatccatcctcccgggagataggcaataaactgtgtcaccgcaaatgccgtcatcattaatccaaattgtgtattggtaaaaccaaacgcatcctgcatggccgcatagaatacatccctcatatatgccagcttgaatatggtccctcctgccacacagattgcaataagcgttgcccattgcttataactctttttcatacgtgactccttccatttgatacaatatattttgttgtacatgtacaggaatatatagagcaatttccatgccaaatcaaaaacattggaaaacagagacgttttctcatcttttggaccaaagagacctaaaaataacaaaaaacgacaaaaaaacttgcgcaaaatttctttcatcgcaagtttttttgtcattttttaattaaaatattatagatcatatttcttcattttatattggagcgcctgccgggttagctttagttccctggcagcggcacttacattgccgctatttctttgtatacagaacaacaatatatttttttcataatcatccataacttctttaagcgaccttccctccatactgaatcctctcgtcgtgggaactactgcatagttggaactcctttgattcactatgtcctggtccgcatgttcccttggctcattgacgagaaagctcctataatacggggaaatatgctccagacaaagcacggaaaggttctcttctgatacggaatatgcactttcaatcacatgctgtaattctcgcacatttccgggccattggtaatccaggaagatctgaagcaccccatcatcaatccgtcggatattctgattgtactccctgttgaaccgctttataaaacagttgcacaacaacgggatatcgctttttcgttttctgagcggaggtatttgaagaatacatgaagacaatctatagtataaatcccggcgcagcttcccattctctatacattccaagggatcctcatttaaggcgcataaaattcggcaatttatatccagctccttctctgatccaatcctgcggattgtcttattttcaattacctttaaaagctttgcctggagtgaaatatccatgctgtttatttcatctaaaaacagggtcccattttctgcctgctcaaatagtccggccatattggcagagcctgtataggctcctttcacagtaccgaagaacatgctttccaaaagtgttgccggaatggccgcacaattgacagatataaatgggccgttttggaatacgctgtggttatgtatactttgggcaaacagttccttacccgtgcctgtttcaccatatatcaatacattcgtctgattttgcgccacatgttttgcatttgagatagcctccacaaatgtgatgtcattaccaaggatactgttgaacgtatactttgtaccattacgcggcttctcttcttcaaaatggttatataattctaggctctgttccatgttcttcttaatcacaggaagattcttaatgagtgaatacaccgcgatagtacggttatcataattcactgggaacatcctctctattacattcataaccctgtgggtttccttaacaacatactgattaatgtactcattggctgctatgcccgtattaagtacgatggcatgacggctgtgctttggcgtgttttccgtgggggaatacaattcttccatgctcttgttcagggatttcttcgcatcaacgccttcaatcacttctgcggcacggtttatgaataataccttgttttcgtcatctgatattacgattccctcttctacctggttcagtacagactcataaatcatattcagctcttcagcggtataacccattttaccctgcatactatttcccccttgtatcatgtttacttttaagttctgtattatcttatcacactaaatctacggaaacaatgtgtaacttgctgaagcattaacccattcgtcctaattcaaacgcaaaaaggcgccaaacaggcgcctaaaaaaattatttcaggtaaaatccatgtcttaccggatcattttcatctataacgaactggctgaatccagttataaaggcactgccggtaatctcaggtatgatggccctatatggccccacattagtctccataatggcttttcctacaaactttgttccgatgacactttcataacaaaaatcttgccctagctgaagctccccctttgcccacattgccgcaacctttgcgcaagtccctgtcccgcagggagagcggtcaatctgaccatcaaaaatagtaatattctgcatattagcatcaggcgacttcgccgggccatatatttcgcacaaatcaacacgtttaatatgttccagttccggatgacgtacctcaatctgttcattgacagcttttataacagccatccccgcttctacgagtttagaagcattatcaggacagatttccatctttatctgacggctgtcaactatgacaaaaaaactgcccccaaatgcaatatcgacagaaatgcttccccaatccggcacatgaatgaccgcatctcttttatataaaaatgacggtacattctgaaacgacacctgtctggcattaccgccctctacagttaccttaaccgtaaccagaccggccggcgcttccatcctcactgttgttatgggttctgtcacgtttaccattcctgtttccaccaaaattgtattaatcgctatcgtaccgtgaccgcacatattatgatatcccccaccatgcatgaagattacccctacatcggcatccggcatagtaggtgaggtcagcacagctccaaacatatctttatgacctcttggttcgagaataagcgctctgcgcaaatagtcataatgttccatgaaatatgcttttttttcctgcatggtgcttcctaaaagattgggtactcccgaaacaatcaatctcagaggttcccccatggtatgggattctactgtatagatatggttgcttgatttcatgacgtccctccattattataatgtctctataatgcctattacatgacttattgaatgattgttattgtccgggacaatataatcagcattctttttaacatgttccaatgcattcttcactgcgaatccggcatctgccatgcgtatcatttcgtaatcattattatggtcgccaatacaacatataaatttgttttccaaatccatcattttcatatactgtctgactgcattgcctttagagacgtccttcacaactatatccctaacgtattcccctgttgacatccaccggcaggttgctggcaggtgtctctccagataccggtctaacgactcccggtcaactaaatcagccaaaatctccaccttgagccattctttaggtaaatcctcaaatgccgtgatgtcctgaaataaaagctcttctctctgcatagattctatatatatcggtgtcggcctgtaacaatatgcagtagtctccgtcatgaactgtatacccagtttgggaaagctaaaaaccaactcaaacagaaaatccttaatacttttcggatattttttcttccatagggacttgctttttccataatcatagatacagcctccattacataatatgactggaatatcaatggcaagccatctcctatatggggcgaatcctatgaccgaccttcctgtagctacagtaaacattcctcccttctcttggaatgtccggatagcatcaagattcttctttgaaatacatttctcattatccagtaaagtctcatccatatcagagaataagaccacatccttaggattcatctgtccctcctgtgatgatatttaagccgtcagaatgccaaacctggcacagatgatggatatcagtataacgcccaacagtatctgtgttgtttttatgtttttacctaatagccaatatataaaaaatgtaactccagcgggtagtaaacagggcatgatagaatccagaacagtctgaagctctgtcatcgcatcacctgagccaaaagtaagggccactttcaaattaaccatggtggccgtcattgatccgattgtcatcagaccaagaattcctgtcatgtcaagtactttacccatcattcctgatttctgtatcttttccagtaaacctgtgcccagttgatagcccttcatcattcccacataccgcaaggcgtatgccggaatattataaagcagcaggaataagatggcccccagaggacttccattcatagccagcgaaactccaatccctgccgttatgattcttaatgtgcccaggaaaatagagtctccaattcctgaaagcggtcccataagactggctttaacattattaatagatgccgaatcaaaatccggattgttcgcccttttctcctccattgcagttacaattcccaatacaagggtggcgaaatatggagtgatattaaaaaattccatatggcgcttaagtgcgtccgcccgttcttcctttgttttatatagcttttccagtattgggcccatggcatatgcaaaccctgaatgcatctgcctaacgtaattccatgatatttcaaatggtatagaacgccaaaacactttcattaaatccttttttgtgattttagtggtatcctcacccaaatatccattagaagtcttcatcatcatctacctccgttcccccattgtttactgcgacagccgtctgtccaagattcccatatgccataagcatgataatactcactgccataatcgcaacaccaagaaccggaacgccgatataggccgtcaatacaaagccgatgattaaaaatgccacgattttcttgtttaatatcatacgcaagaggattgcaaatcccaaggccggcaggatacctgctgatacgctaaggccatcctgaataaattgcggaatagagtttaaaacctgttccatcacgctgcttccgaaataaaatgataccgctaccaatatcgccaatggaagatacataccaaacgttccgccaaaccaatgcatccttgacacccctttgatatcgccttcctccgcatatttgtctgcacgattcatgaacagcggaaccactacgatgaataaaacgttcctcaataacataaccagcattgcaatgggcaaccctaaggcaactgccattcctgcatccttatgacctgcaattgcaaatgcagtacccaaaatgccgccagaaaccacttccggaggcaaggcggccccaatacccacagcccccatcatggcaagttcaagcgtggctcctatcttacatcctgcttcaagatttcccatgacaagacccacaagaggaccaagcaccagcggccttgtcagaagggattttcctgtaaaataatcactatatccgacacatgcaataagaaaaatcaaaaaaaccttcaacatatatgtaccctctctcaaaaattatagtacccgaactgccatcacttttttatcattcggaacttgcctgatttcaacttcaattcctgcatccgccatcttctttatcaatgcctcttcatccggcagaatattgattgatttagatatatttctggttccttccctggctttcacaagaccaagattcactttgtcaattgccggtacagccagagcaagcttcgccgcatcttctatggattcaaccacaataaaaagtttatacttatcagtcactccactatttagagcctgaatggaatccgcaatattttttatcaccaactttacgccggacggttttgccagtttcatggtggtctttcttaaatcatctgtcacaacttcgtcattcgctattaatatgcagtcagctcccagtcctgatgtccatgatactgctacttgtccatgcaacagcctgcaatccacccttgtcatcaatatcattttttatccccttccttaaaactcctcatcctcaagttccttctccgcatttaataaatcattgcaaaaacaaatggattccttagcttcccttatgctctcatggataattctctctgtcggttccccgctgtctttttttatcagaagactcataacaagcgggagattcaagccggctatcagatatattttcttatctgtatgtttaataacggacatgaactcattattcacgcttcccccaagcacatcggtgacaataattaattcatcctgttcagaaagtctccctaaacacttccctatattctgctttatgtcatagtcttcatccgtataggcgcacatgatatccaccgcttcctgcttacccatgaccagattcaatgaactaagtaatccttctgcaagatatgcatgtgacgcaagtaaaaatcttctcatccctgcctccctctttccttattaacttctccccgctgtttcccatcatccccactcaagccctactcccatggtcttagctttctcatatatggacctagctgtaattaaatcctggatggcaattcccactgtctcaaacacaagtatctcttcatcattctcacggccggatagttgtccggtgattacgtcaccaatgttgccggtgaagctttcttttgatatgatgccttgacttagtggaattattatatctcctgactcggataataccgcatccatggaatcaaaataaatcttggcagccctttggagaactacggggtccatctcctgcatgtggggctgatatgcacccacacagcttaccgttgcgcctttttttatcttattcccatcaaatacaggcacggcggatgtcgtcgctgttatgatgaggtccgcctcatgaatcgcctcatcagatgattttaccgcaattatttcagcattataaaactgaaattttttctgcatacgtagtgcaaattcatttgtcctgtcaaagtccaaatcgtacacctttacctgctccagactgcgtgaaacgagcattgcttccaactgagtttcagcctggccgcccgttccaattaatgccccaatcacgcagtccttctttgccaggatatcaaaagccactccagaggccgcgcctgtcctgagctgcgtcacatacgtaccatccaaaacagcagcagtaactcccgtcttgccatcaatcagaataatctgggccgaggtaacagggatacctttatcacgattatggggaaatatattcaccatcttcaatgctgccatgtccatattttctacatatgccggcataaacaggaaacatccatcatatccaggcgcttgtatattcgtcctgagcggtatattacatgcatccttcgcagccagttcaaaggcttctttatcagcctcaatggcctctttcattgtaaataccttactgatgtcttcctttgataagagtatcatttatttcctccttgtctacttattataatccggattccagggctgcatggctcccccttcttctgccggacggcacattctggcatatagattcaaacaccctttttcttccttaagcggcggacacacccaattcttcctgcgtatctgcagttcttcctcagatactaaaagacaaacttttccgttgggaatatcaatcagaatctcatcaccattctccacaaacgcaatcgtcccaccatcatatgcttccggggacacatgtccgatgatggcaccataattaaatccagaaaaacgtgcgtcggtaattaatcccacactgtgatgaagcccctgtccaataagtgcatcaatactcagcatcaattccttcatgccaggagctcccttacacccctcataacgtattacaataatgtctcccggaataatcttccctgattggatggctaaaaatgcttcccggtcaccgtcatacaccctggcttttcctttcatgcattttacttcttcataaactgcggtaggcctgacaatggctccatttggtgataaatttcctctcagcaccatcagtcccggttcattatataacggccgctctatcgaatggataaccttgccttcccttgcctgtactttacccagaagagaggaccatgggcacccataaatgctggggacatttgtatacagtcgctgttccagcattttcattacattcatgactccgcctgcatagtgaaaatccacaaccgtatatggaccattaggaacgaccgcattaatgcaaggaatttctttagcatacttttcaaaatcctccatagtaagcttaatccccaattcatatgcatatgacaaaatatgcagcaccgcattcgtcgaaccagccaccgccatatcaaacatgatggcatttgagagcacttcttttgtaataagtccggaaggccttctgccctcttgtgccattatgacagcatgtcttcctgcttccctggattttctaagttttaaattgtccgatgcaggtattgtggacgttcccggaattaccaggttcatgacctccccaagcatctgcatggtattggctgttcccatggagggacatgccccaaacgatggacatacactctcctctaattccgccagtctctccatatccataccggaaaaacgggctgtgtccaaatccgcctcgaccactgtcctgccacaatagtgtcctgcctgcatggagccccccgtcactacaacagtagggatatccaggcgcatggcagccaggtaacatccagctatgatgttatcacaggaggcaatcatagccaacccatcaaaattgtggacacggcttacaaattcaacagacattgcaacaatgtctcgtcctacctgctcatacttaagctcctcggcgccatttgcaatattaccgcaggttgcgggaatcccgaactcaatcggaattccccctgcctcccatatcccttctttgaccgcttctgcaatctgacgcagatgtgcagaacccggtgagccggacatatatgaatttgggacgcctatatgcggttttttacggatatcgtcatcagaatacccggctgctttcatcatgacccttctatgggcagcttctgtaccattccaaaaatcacttcccatgtacatgcacctccgcatcttaaaatcagcttctactcctgcttcctagtattcaactttccacatgtatctgcgggtcatatagtcaaccttcgttgcctttgacagagccttcatatacacgttatttaaaattggggcaaacagcatatgattgaaatactcacacacggtatccttaaaacgattgattcccagttcctttgcatctaatatgtaaaccttatccccaccatactcttttaaaaatttaactgctctttcatcagcccttctcgtccttccttcagccacaagaaggaaaaatgaccctttcttgtccaccacctcaaacggcccatggaaaaactcacagctattaactgtaggggattgaatctgaagcatttccataatattgcagatggagaatgtataaccggcggcaaatgccggtccgcttgacaatacggagatgattttctcatctttgtttttctccgcccactgttctgccaacggaaggcagtatgcctttgcatcgttatatacgcaatccaaaatagtaaatgcgctcatcgcatcatcataattgtcatatccctccgtcacatccacgatgtccatcgcaatccgaagtcccagcgatgagtttgtcctgctctggtctgattcatcaaacataatactgtcgtactttacattatattcacatgtttctgtaagcagcgattcctgaacgtaaaggccaattgtcgttgctcccatatcacgcgcaatctgagccgcaacacaagtctccggggtgcctctcatagaagtaatgactgctattgtattttcatttacgaatttgggtggagcatagacaaattcattgctggtgaacatctgtgacctgattgttttcgcttccctatccataaaatattgagccggataattccctccattagagccgcccgccgccagccatacgacacttttaatccccccggctgattccttttctcttgcgattttttcgattatttctcttatatccatgatgcttcctcctgctattcaaatcatactatgtgacctggcaatcaatacagcggcgcctttactgtataaactgcgctacggctaacttgtattagcacgtcttaatgcaagtatatagtataatttgcctattgtcaagatttttcatcccttcttttctataattattgtatacaaaaaggcacccttacaaagtgcctttgaattttccgcaaaatgacttcctaaacataccacttaaagaacctgtcattatcccctcttacaatctccttcaccgtgttgataggttcccctcctatgtcgaatacacacatctcagactctatgacaggcgtccctaatgacaactgcagatattctgccacctcttcattggcaaatgatatcttaatgctccttctccctttattggttgggtaaactttatatttattctgaactatttcatagagtgaatgagataaatcttcgtattttaatccctggaacatgatgggaaaatgactctcttcaataataacaggagttccatttacttttctaagtcttttaataaccatgattgaatcaccatcaaccagcttaaagaattccttatccaattcacttctaaccgtctccgcatcagcctttataacttccgaatcgaccttctgcccctgcatcctggcgtcctcactgaggctggtgacgccgaccggtaaccgcagcatgtcagaatgtgctacaaagctcccctttccctgaaccttaaaaatatatccctcggattctaattccgccatggcattgcggattgtaaccctgctcatgccataccctttttgcatctccgtttctgaaggaagcttatcccccggcttcagtaatcctgtcctgatatcctttttaattttatttttaacctgcaaatataaaggggtagattcattcttataaaagtcactcatatccatacactccacgcatctcgtattaagacgtattttaatacatctacatactatattacagtattttcaataattctgcaaggaaacatttttcttctaaaatatcttatatcatattaacggtctctaatttacactttatttcttgtcacaaaatattgctagtaagaagtgagttcccccggcttatacagaatactgtcctgttccccggatactttgacaggacttttacggactccgaattcggtgtaccccctcaggctgacggcgcttcctaccgacgcactgaccgtggaaccagatagcaccagcgtgggttctgcattacacctgcaatgctgggccaaaacttccgtctgaccggtaccgcccataatattagccattactaccatatcagccgccgcaatggcagaattcacccgattgaaagacaatataaagctttccactttcgattcctgccgggcaattgatttcgcagccgtcagaagaattgtcatatgtccgtcatggcagtatccgtgataatcagtcatctctccatctatgtaaaacgcaagcgcatctgtatcagctctgagcacaaaatggtttcctggttttccgctgtcaagaatacccaaaacaccgccgcccacattggcatccacctgatagccgaattccttcagtttttcagccaggtatgcacagttacccgggaagggagcgtactccaaaacatgtttccttttttctgttctattgttaaaatgggtacttcctggcggcccatcctgccccaggggatggcccacatcgtaaccggacttctcccctggcgtggcatttgtatttatttcagaaggcggtacagatttgagcttcttcccccgttgtcacacaaccttgtctccttttgtataaagccggcttttaccaaatcatcaattccacgtttcacagtattcctcgataacataagttcttttgatatggtaccgatggagggataacacgtaccattcttatcagttcggtctttcaggtacatatacacactgatagcacggtgcggtaatcctgactgatatagtttacggaaatatcccattcctcacctcctctaatccacgcggaccggcagctttcctccgatcgtacccggcctcccatgttcccttttaacaagcatactctctgaacatcttgtttctaattcactcatatcctccatcgctgagagctcaactgccagctgccggttcataatctccatctccagttccagcttgtccgcatagcttaccttcctggcagcccgttcctgcaattcataaggttcttcaaatgtaatcccccatttcaggaacagtttcagcgttgcctgcattggatgtgcccctgtcttcgtcacaataaatgttccctttttcagtgccttgattgtacacagacgtctccccttatccatttctgacaaagagattcatcaatacccgtttcagtccaatatcttttcttcctgtcataaaacatattaatttacagttatctcctgtcagcatttgcgtttcacctcctccactcattcgctgatttgtctgatggtagttaataaaccatataaaaacagccgcttacattatttcttgtgtaagaggctgcttaatttttaaaccttttatttgaatcaaattataaaaccttgataaaatcattttaccatacaatgcttacaagaatattacttatttcctacttttcccatatatttgttttctcttccttcttcctatgaaatatataagagactaatatgtctatcccccgggcacctccttctcccactatctgcatcacataaactttccataacggcagaacggtttcagcttctctggcagaactatcctgatataccgtagagctaacattctcgccatctccttgcgtcccatcttatcagaagggacatacacatgattttcatagcctcaaataatatcacatgctttccctatgttttccggtaattcagcttccagtatagcatagagtttttccttccccagtatcctactccggatgaccgccctgttgactacaacagctaccatttctagttcagataacgtaattcctgattaaagataacacggaagttcgttcgtgggttttatagcagatatctgaaatctcattcgtctttctcaaatctgtaatcggcattatcagtggcatagtatccctcctctttttgtacataattatatacaaatttcaatctgtatatatcgattccaaccacttgattatgaattacacatctttttccagacctcacagtcgaatggtttattagaattgaaaaagcgatatgcgcctctttgcgggaaccgcataccgcctaatcctctatctgcagcccctttttaggagccagtatctgtttatacatcgctatctgctgaaacactttcatggctggattcttccgccaaatcagcctgatctgttttgtctgcttttatgtcagcctcagtatcttcaggtgaactctctccatttgttgaacggtcaatctttgctttgaactctgaatgagcaggattattcactttcgcgtcaaatcctatgggaagatattcctcagagattactttctcataatcaatgtccgtaaaataattacagaatgttaattccacatagatgatttttctttgcgcttcatctcccatggcatagatatatccgttatagtcattggcatatacagcaagaagcggataaggaaattccgttgccccatatataaaataatcctcaggcattggaatctgcttcaaacgttccttctctgcgtcataatcattctcatcacagtgatagaccaggaagctgagataacacggatcccagggattataatattcgtaataaaactcctctacttttgcggagtcaggcagttgttccggaaatatgtcactgagcagcagataatactcccctgttttcttccagacttctgtgtccctggtgcggtggattcccttcgcaccaaagtaggattcataagccccaatatcggtaactacatttttctccacccaatgggtgaagatgtacacggatgcggtgactatggtccccaaaaccaaaataaagaccaataccgctctgcgtattatttttgttctcttttccatagtaatctcctgaatgatttaaccggccattggatagttaaagcaaatcgcgcgcactacctcttgctcatccaacacggcaaagcaggggttccatactccgtagaagaaattgtttataatccagaagaggacgaagaagtatatctcaccctgaccaggcaggtttctgatgccgtcttccagcatctatccaacagagaagccgtactactgacaggtggttactgcaaagatgcggttggggtttgtggaggcatccaacatgccagtggtgctgacaaaaaagtgggtatcatctatcttgacgcccatagtgacatgtcaactccggcagtcacccatacaggtattctgggaggtatggatatggctgcaatcctgggtgtggacatggcaaattggcgtttcactgccgggttgaacacgccttatgatgaccatcttgtgattctcagtgatttccgcgaagctgaaattgacgacgatggcaccttagaaattgtagaaggatctcatatcaactggataaaatccgaaggatttgaaaatgaatgccttgggaaagaaaatgtgaataacctggcacaaaaggtagatgctatttatctccatatatatgcagacatacttaataaccgccatgttcccaatgcggcctgcgtggcagagggcggtccgtccatcgatacagtcatgaataatatccgcgctgtaatgaaaaccggaaaagtactggtttatggtacatatggattctactttgataccgaggttcccggtcaggattccttaacattaagcggcttaaggatagtttcagcgaggctggaggattggagttgtttcctgaactggtataaaataggaatgataatctggcaggaaaagcgagtgtctccacactgcttttacctgccttgagtgtgtgaagaaaagtctgtaaaagctgatcttctatgataataactgggctgaaagttctttcttggaccttcagtccttgtcgcatacttccgcacatttccggaaacgccaaaaatgctcttcccataaacaatagtatcgtaagataggaaacatacctatacttgaaaccatcattgataaacagtatatcacaaagaaaggaatgatgaaacatgaaagcattagtaatctatgacgacaccggccgtatatggacgattgtctacggtgaggaacaggttccccagggcctgcagtgcatatgggtggacatccccgatggtgcacagctggaccatattaatgtgacggatgaggacaacccgcagccagtctttagttatctgcctgaatcagatattggacgtctgcaggaacaggtggtaagtctgggggaccaactcacagaggcacagttggcgcttaccgagcagtatgaggccaatctggcgctggctgaagagataaccaacactcagatggcactgacagaaatctatgaaggaatggaggtgtaaggtatggcgagctatatggcaactgtgtatgcggaccttatccgcaagggcaggaaaacgattgaacaggtcccagagaaattaagggcggaagtcgaggcggcactcaatgcttagactgctgctctttttattattgagaaaggaggcagacaccatggcagtcatttatgcaaccctgattgtaaaggggagaaagacattcgggcaggtcccggataaaattaaggaccaggtgcgccaggtactggttgacttggaatgtgaagaactgattacagagtaggtgaggtacatgaaaatgaagaaagatattatatgcgctattactggtatggccgcagcggcgggagtaaagctttttggtggctggactccgacactgagtatcgtgctcatacttatgggactggacctgatagcgggattcctggtggccgtggtgtttaaaaagtcaccaaaatcagagagcggtgcggccagttcaaatgccatgcttaaaggactgtgcaagaagttcatgatggtgtgtctattggcggtagcccatcagcttgatgtggccctgggggtggattacattatgctggcagctacatatggatttatcgcaaatgaggcattgtcgattgtggagaatgccggactcatgggtattgtcaaatccgatgttatagtgaatgccattgaagtgttaaaaggaaaatcgcagaaaacagagtaattgcgatatcgcaacagcagaaaggcaatgccatgaggacattaagattcaaagtatccggccaggagctaataagggctcctggctgtgattttagtaacataattgccggtacatccggctacctgcaggcggcgtttgagttcggcccggactgggacgggactgtccgggtggcggccttctatccgtacttgcagtcccaggaggttggcagactgataacagacggtgtctgcattgtcccggatgaggtgacggcctatgacacatttaaaatcggggtggttggccagcatgagaatggccagaggattaccaccaatctgattacgattaagcaggagagggggagtggacaggcatggcaacagtaaatgaaatactggcagcacaggcatatgcagctgttgacgaggcatggaccaaggataataattacccatccttccatctgtacgtggagctggagtatgttccggtcaccaacaagcgcattgcggatttcaacgaccagatatctgtgcgtggcgaggaaaatgctcagttcgtgggcttccagctgccgcggtacgatgacggcctggaccttaccgtccagcgcctgtatatccactaccagacggtccatgggggtggggacagcgtaccctgcaatgtgtcctggtcggacaattatgtcaggatgtgctggcaggtaccggcacaggcaactcaggaacctgggtcaatccagatgatgatatatgcgaccggcactgacagtgtaggtgagtggaccatttggaagaccctgccggcaacgtatgatatccatgacggactggaaatcggaggaggcatcctggaaccagacccgtcttggtatgaacagttcgtgcagcagatggaatccagggtaaccactgcccagggatacgccaatgacgcccaggccagtaagacagccgcctccggttctgccacggctgccgctgagtctgctgctgcatccgccaaggcattggaggataacaaggcctacgtggagtctcagaaggatacctttgtgggctacaacaagcgtgagaccgacctcaagtacgccaatgctctcataggctccgcgtccggaaccgaacgggtcagtatagaggatgcgtgggaggccccaatacccggcctggagatagccgggaggagcgagcagggagctgaccccagcccggataatccgcaggagattgtgagtacggatgtcacagcggtgagggtgacgggagcgcaggttttgccatatccatataaggatactacaaaaaccgaaaatggaattacctttacagaccttggtgatgggggaattaaagttaccggaacctctacagccacatatgcaactttcatgcttaagcgtattacagatgatgtgattcttccgccgggcatatacgcaaaaaatgcgcccattgaatctggattgttttttaatataaacagatataaaaatggcgcatatgacacaacaattgtggcctccaatgttaatactttcgatacatcatcatgggattacacccaatatgaatatcagataatcttgcaagttagagatgccggagtaacattaaacacaacgttttatccaatgattaatcagtccaaaaccgcgcacatctccctcacggagccgttgcatggcatcggggatgcaagggaccatatcacatgccgggatggtgtgtggggaattgaaagaagaaggaatttagcggaatataatggcataacaaatcgtgtggaatcgtttattgcatcctgggatgaacggtatccaggttttgcacactgtaatttgactaaaatggatgactggttagtaggacaaaaaaatttcatgtctgatttatttgcttgcaccacagaagacaatcgaaattttagcaacacggaattatcatgtcacacatcaaataacggattacagttatttttatcttttgatttggcaggaattattaatgctgacgatactgcaacacgcatcacaaaagttaatacttggatacaatcccataatttcacggttgagtatgataaagctatcgctacttggacacccctcccagccgatacccaagcagcccttaatgccttgaccacctacaaaggccagacaactatcatggtgacggcagatgggacggaaccggatgtggggctggagtatgtgcaggataccagggcggtggtagcagatttacaggcgcagattgacgcgattagaaatggaggtacgacatgagtaagacagcattaggattaattcagcattgcaaggacaagctgggcacaccctatgtctacggcgccaaaggcgaggtccttacccgggccatcctggacagacttgcccgggagaacccaggtacatacacatcaacttataaggctaaggcggccaggtacataggccagcgctgcacggactgctccggcctcatcagctggtacaccgggtgcatccgcggcagctacaactaccatgacacagccgtggagcgggtaggcatcgaccacctgaatgagtccatggtcggctgggcggtctggaagccgggccacatcggggtgtacataggtgatggatactgcattgaggccaaaggcatcaattatgggaccatcaagtccagagtgaccgccacaccctggcagaaggtgcttaagctgtgcgacatagattacaatccggtacaggtgaaatatgcccaggggtttcagccggcggcagacgggcagcgctggtggtatcagtttgcagatggcagctatgcggccaacggttggtactggctccgggaggccacggatggaacctgtggttggtatctgtttgatattgcgggatatatgctaacaggttatcaaacagatgcatcaggtgagagttttttgctttgtccagtcaagggcagtgacgagggtaagtgcatgattacggatgccaggggagtgctccggattgccgaagagtatgacatgattaaccggcggtacgtgtttgagtggtaaggcataatataccataatttaccaggacaaaccctgctttgaaaggcgtacaatggccttgaaaggaggcgcataaagatggatggaaagcggaacgatgaaccgccagaaccggcggaaaaatactcggatgaagaactgctaaaagaatttgaagcagtcaaacgcatgaccgtccccttacccatcccggacccgaagccggatgaatttgagaccatctggaaacggattcaggatgagaaggagaaagaagagaagtgagtgataggcgggtgccggaatgtgaccgggcccgcctaaataatggctgacaataatctaaaattatgctataatcaaatcagtaaaagccttcggaaccgcagttccaggggcttatttaccatcatatgttattgacatccggagggccggatggcgaaatgggcgcatccatgcgttacctttcccagcgctatgccatgccatataaagaatgtaaaggtgctttgaccgatataggtacagaagagcttgcccacctggagattgtggctgccatcattcatcagctgacaaaaggcctgtctgcagaccagctggtagagcagggcttcggaccttattatatcgaccataccacaggtatctggcctcaggcggcaggaggaattccttttaatgcatgtgagttccagtcaaagggagatgtaattacagaccttcatgaggatatggctgcagagcagaaagccagaagcacctatgacaatattctgcgtgttgttaaggattacgatgtatgcgaacccatcaaattcctgagggaaagagaagtggtccattaccagagattcggtgaactgctgcgcattacccaggagaaactggacagcaggaacttctatgcatttaatccagcctttgacgtgccagcaccttcctgccaggaccagatggggcagatgtaagctgcacttagtactggataaataaaatgcaataaggtgtaacagatataaggctgtcctgcaccgaatcatgcgtgaaaggcgctgcgggccattggtaaaaccatgggccgcagcgccttatcgtgatgttgccggcaggcaatacatatcattcgttttgcttccggttcagagcagttgtcatccgtgcagcattgcttccggtacagaggagctgtcagtcacccatacagcgttccaaccgcaccagttccccgccaatgagttccacatcctcctcctgatgggttgacaggatgagcagccgtccatcctgtttctccttaatatatgaaatgacattgcgtttcaattcatcatccatacctgtaaagggctcgtccataagaagaatatgggagggggtgagaagggcgcgcaccacagctacccggcgtttcatgccgccgcttaaagtggatacaggacggttcaggcattcctcgggaagcaggcgggacagttcccattttatccgggagggtttgactgaccggccggcacacatggatacattttcaatgggagagaaggattcgcagagcctgtcctcctgaaagacaggggaaacagtcagggaactcatgtcctggggctgtccgtctgccaggatactgccctggtccgcctgctccagtcccatcagaatacgcagaagggtggttttgcctgagccggaaggactcatcagacagtaacagtgtccctgatgaaaggccaggttcaggtttttcaatacaggcaagccgtcaaaggatttagaaatattctgtaattccagggtcattccacatacgctcctcaatgctttattttctttaacagataaagaaagaaacgctcaaacagtgcgctgattactatgatgacaaaggtccaggcaaagagtccggccgtgtcaaggtacagcttggagtagtagagctgttctccgatggagccttccggtatgccgataacttctgcggccacgccggatttccagctcattcccagggcggtacggcatccatttataaggtagggaaggagggccggcacatagatataatgaatccgcttccacatgggcatgcgaaagaccctggccatctccagcagcttttcatccgtgtgctccagtccggacaaggtgcttacatagaccatgggcaccacgaccaggaaagcggtgaacactgccaggttgcgtgagccaatccaaatcaatgccagaatgacaaacgaggcaacagggactgacttaatcagcagcatgaccgggtccagcagttctttgaccaggggaaacaggtaggccaggcttcccaggaggatgctcagggcaaaggcccccaggaagccaaggctaatcctgccgaacgaattcaggatggtggtccagaaggaagggtccgccgcctgctctgccagggcctttatcatgtccagagggcctacgaatatgatgctgttgtgtatcagcagattggctgcctgccatactgcaatccagaacagccaaaccagatattttcttattcgtgtattatgtttcacgggttggttcatgaggtatgtctccgaattttaaggcacatagtaaaaatcgtctccgggcatctggccgccgatggatttagggtcctgctcatgtaaggtggacagatagccgcttaaggcgtcctccatctcctgtcctgtcagacatacgatgttgcagtagggaagggctttctgggcaatgggagccttctccacaataccctgctctgcaatcagccgggcggcatcctcttcatgttccgcagcgaaaagggtggaagcctcatggtcttttacgaagtcttcaatgggggaacggttttctctgaggaaatcgctgcgcaccagggtaacgcctgtcaccagcatgcttccggtgtctttgttcaggaggttccactgctccgtcaaatccagcactgtttttaagtcagggttctggatgcaggcagcggtggcaaagggctgggggaggacgccgatggcgccggaatcctgtttcagcaaagatgccacctcggtggcttcggacttaaactgcaggtccacatctgaggcggaaaggccatttccttttaacaggtaattcatcacatattcaggtgtggtaccctttccggtcatgtaaatggtgcgtccctttaagtcggccatggaggtaatggaatcgtctgaggccaccacatagagaacacccagggtgttgatatccaggaccgtgacatttccctgggtcttggcatagagcacgcttgcaacattggcaggcagcagggcaatatccaggtccccgtttgcaatcttgcctaccagctcgtctgccttgccggccatggtgaattcatagacattggaggtttcgcccctggcagctttatccatcagggatacaagtcccatggaggtagggccttttaaggaacctacacggatggctgcctggcaggtcagcttggtttcatcagagccggtgttcagttcactgccggaaccggattcagagtcagcggatgaggctgcaccggaagggctgtctggggcctggttctgggcagttttgtcctcagctccggctgcggtctgggcatcagacggcatatcggtctgagcctcagtctgagtctccggggaaggcgtgacggcagtttttttgccgcatccgcccagtaccagggaggcgcccataaatgccattaaaagtaaggaaatatgttttttcattatacttcaactcctctcgtaaatatccttaactatagcacaacaggcctgtcttttctataaaatatttgagaaatattattgatataaatatcacaatgtgagataatgaagccatggttggggtgagcccataatacacgcagatagtggaggaataagggatgaaagtaacgatatgtattggaagtgcctgtcatttaaaagggtccagagagattatcagtaagctccagaagctggtggatgagaacggcctgtctgataaagtggacttaaacggtgcgttctgttccggcaactgtgaccatggagtatgcgtgacggtggagggtgagctgtattccctgaagccggaggatacagaggaattttttgaaaatgagattaaggggagactttgattatgggcatggaaatcatcgatttcaaagccacaaagtgcaaacactgctataaatgcgtccgttactgcggggtaaaggccatccaggtcaaggatgagagggcagtcatcatgccggacaagtgcatcctgtgcggccattgtctgaaaatatgcccccagtcagcaaaaacccttaagagcgacctgaatatggtccgcggatttttgcgcgaaggcatgcgggtagtggtgtccattgcaccgtcctatatggggttattgaaatacaagacaatcggtcaggtgcggggagctctgctgcgcctgggattcgaggatgtaagggagacttccgagggggctgcttttgtgaccgccgaatatacgaagctcctggcagagcacaagatggagaatatcatcaccacatgctgtccaagcgccaacgacctggtggaaatctactatccacagctcataccttacctggccccggtggtgtcgcccatgattgcccatggaaagctgctgaaggaagaactgggacgtgatgtgaaggtcgtgttcctgggaccgtgcattgccaagaaaaaggaagccatggacctgcggcatgagggctatattgacgctgtattaaatttcaatgacataaacaaatggctggaggaagaggacatcgtaattgaggactgtgaggaccggccatttacagcatttgacccaaaggtgaaccgcctgtatcccgtgaccaacggcgtggtaaattccgtgctggccaccgaggaaaagggggacggataccggaagttttatgttcacggagaggacaactgtattgatttgtgcaggagcatgtcccgcggtgaaatcaagggctgttttatagagatgaatatgtgttccggcggctgtatcaaagggcctacggtagatgacgagttcatatccagatttaaggtaaagctggacatggaggaaagcatcagcagggagccggctgaggaaaggcagatggagccggtgtgggaaaatgtgaacttcaggaaacggtttgaggaccattcgcccagagacccccagcctacggaggaacagatacgggaaatcctgcgcatgaccaacaagttaaagccggaggacgagctgaactgcggcgcctgcggatatcctacctgccgggaaaaggccattgccgtattccagcacaaggcggaagtgagcatgtgcatcccctttatgcatgaaaaggcagaatccatggccaacctggtaatggagacctcgcctaacattgtactgattgtgggagaagacatgcgcatcatggagtactcggatgtgggcgagaaatattttggcagaacccgttcacaggcattgcagatgtacctgtatgagctcatcgacccggtgaatttccagtgggtatttgatacgcatcagaatatccacggcaagcgggtgaattatccggagtataatctttccaccctgcagaacattgtgtacatagagaaggaaaatgctgttctggccaccttcatagacataacccgagaggaggagctggccaaggaggagtatgagaaaaagctggaaaccattgatttggcccagaaggtcatacataagcagatgatggtggcccaggagatagccggtcttttaggcgagacaacagctgagacaaagaccactctgaccaagctgtgccattccctgctggaggacggcagcgatgccgtgtatgccgggggagaactggaccgggagataccgggcgtacagttgggaagcggagccgtgcccttaaagggagtcatgacagccggaaatccggctgatgatggaggggagcagaagaagccttctacgggatatgtccatatcggcagtgcaaatccgggcggcggaaagaccgggtatgtccatctgagcaatgcggatttaaagaaaccaggcggcaacggaggtagataatgggaattacagtggatgttgcatataaaagcctgaacaaatacaccgaaatcctgtgcggggacaaggtagaactcctgcagaccgaggattccaatataatgattctggcggacggcatgggaagcggggtcaaggccaatatcctgtccacgctgacctccaagatactgggaaccatgttcctcaacggggctaccctggaggaatgtgtggatactatcagcgagaccctgcccatctgccaggtaagacaggtagcctattccacctttagtattctgcaggtataccataatggggatgcatatctggtggagtatgataatcccggctgtatattcatacgggatggaaagctcatggagatacctaagaatgtacgggttatccagggcaaggaaatcaatgaatacagattcaaagtcaaaaaaggcgatgccctgattctcatgagcgacggcaccatccatgcaggtgtgggagaattgttgaatttcggatggctgtggcaggatatagctgattatgcagtgagacagtatcctctgaccgtgtcagccatgcgtctggctgcatccatcagcagagcctgtgacgagctgtaccagttccggccgggggatgacaccacggtggcgtgtatgcggattattgacagcaagcctgtccatctgatgacaggaccggccagaaatccggaagacgatatgcgcatggtccatgacttcatggatgaccccaatgccaggaccattgtatgcggcggaaccagtgcaaccattgtgtccagggtgctggggaaaaagctggatgtatcgttggattatgtggacccggagataccgcccatcgcgtacatggatggcgtggatttggttacggagggtgtccttacccttaaccgggtgcttcagctgcttcgcagatatgtgaaaaatgagactgtatccgaagaatttttccaggagctggataagcccaatggaggctccatggtggccaaggtactcatagaagactgcacggaggtccacctgtatgtgggcaaggccattaacagtgcataccagaatccgggacttccctttgacctgggtatccgtcagaatctggtggagcagctgaggcatgtgattgaggagatgggaaagacagtgatggttacgtattactagttttgtactccatttaatacttgcatttttagagtaaatatagtagatttctagtgttgatataattttaacaaactcgaattgtgataatagagcagacatatatggcacgggccggtgatatgtatcgcacgtaggggaccaaaggacggtctccaagtgcttataacgaaccactgcactaagctcgaaagggacctcgctaagtgccagtgatatgtatcgcacgtaggggaccaaaggacggtctccaagtgctcataacgaggaggagaaaaaaatggtaaccaatgatgcgacaatcctgcgtttaaaacatgatgtactttacgaggtggctaaggctgcatgggaagggaatctggacgagaagcgggagaagattccatattccatgataccggggcctcaggcgacgtaccgctgctgtatctataaggagagggaaatcatccggcagagggtacgcctggcagaaggaaaatgtcctaccgggaaggacacatccaatgtggtccaggtcatcaatgcggcctgcgaggaatgtcccattgcatcctacatagtgactgacaactgccgtaagtgtatgggaaaggcctgtcagaattcctgtaatttcggagccatcagcatggggcgtgagcgcgcttatatcgagcccagcaaatgtaaggaatgcggtaaatgttcacaggcctgtccctataacgcaattgcccatctggagcgtccgtgtaagaaaatttgtccggtggatgccattacatatgatgagtacggcatctgtgtgattgatgagaaaaaatgtatccagtgcggagcctgtatccatagctgcccattcggagccattggttccaagaccttcatggtggatgtgattcgtctgattaaggcaggaaaacgggtggttgccatggtggcgcctgccacagagggacagtttggttctgacattactatggccagctggaaaattgcattaaagcagctgggatttgcagatatgatagaagtgggattgggcggagacatgacagctgcctacgaggcagaggaatgggcccaggcccataaggaggggaagaaaatgacaacctcctgctgtcctgcctttgtgaacatgattaaacagcattttcccacattgctggagaatatgtccactacggtgtcccctatgtgtgcagtctccagaatgataaagagcgagaatccggatacggtcactgtctttatcggtccctgcattgccaagaagagcgagagcctggatttgaatgtaaagggtaatgcagactatgcaatgaccttcggtgagataagggccatgatgcgcgccaaaggagtggagcttcagccggctgagaatgactatcaggaaagttctgtgtttggaaagcgttttggaaacggcggcggtgtcacagcagccgtactggagtgcttgaaggagatggaggagagcacagatatcaaggtagcccgctgcaacggggccgcagaatgcaagaaggcactgctgctcatgaaggttggaaaacttccagaggattttgtggaaggaatggcatgcgtaggcggctgcgtgggcggtcccagccggcataaaaccgaggtggaggccaagaaggccagagaccagctgattggttctgcagaagagagacatgtgctggagaatctgaagaagtatccgatggatgcgttttcgatgcataggcattaagctacggtagtttagatgccttcgccctgggagatggatgcgcccagggcctttttggtatttcgggcctttgttttcttgaaagaaaggccaatccatagaaaggccaatccatttttccatctcgttcaacagagtggtgcttatatttgtgccatgagcgccgtttgtcaatagtctgaccccgctgcttgaagcggggcagtttttatttcatgactttagctattatagtaaatgatattcaggctctgaacataagtatgctgctgcaaggaagagttcagctccacattatgatactgcgccagaagccgctgtacaatttgaagtcctttccctcggccagggcctttacttgtgtttccggcatagattccccgcatggtagtctgcgctgtaatggaatttttgatgatatatgagcagccctcatcatttccaatgattttaagctctattcttccgtctggtatctgtatggtctcttcaattgcattatccagcaaaatacctaaaatgcgcgtcaaatcaatgacatccatgccggtctggaaggtttcgggaattatgcggacctccataccgactgttattttctggcttaatgcttgagaaagtttcaagtggaaaaaggcgcgcagtgattcaaccggaacctggtacaatttagacagcagttcactctgatggatggtttccacagaataaggataaatcttgtcccagaaaaaatgtttcatttccgtgtcattgctgcgttctacgaaatttcccattgtaaaaaagatatttttgatatcatggcgcatttcctgcatggcagtgaggtttcctgtaagctctttataataagatgcaattccttctctttcccattcatagaaggtggcattgtctttatagaacgcgacacggaaaagaagtacaataaagggcatttgaacccaaagcaatgtcaggcagaggcatgggaacaacagcataaccgcggtattctgtaactgcatgatagaaaaaggcaggaagattagtgtgaaaatcagtaaaatcagaagggaaaaggaaaagaaataccgttcaattgttcggtattttctgcccaggctgtttaatttcatgagccggtcattgaaccgtactttgaccaaccaggtaagccctgataatagtgtgagtattgcggatataaaacatacgattccaaaagcagagctttctgccagtttacttaaagcaggataaaaaaaatgggccgccagcgagtaggagtacatggacagtgagagaaacacaaacaggaaatagcatacaaaatgatgacctcccagatgatggattcctagccgggcagtggtatagataacgcaaaacagattccagaaaaaccacaggtgacccaataaggcggaggttgtgtcaaaaagcctgtttggaaagagcatagcagtaaacaaaaaagcataatccagagcttttagagggattagattcagaatgcgcacctgtgccgtgataaggaaagcaaggaaaaaggaatataagaattccgatttaatgcttactgaccagacatacatgatttgcagaaccggcagcagaaccgcagctgccagttcaattcgtttcgatttttcagtgtgtttcgatttttcggtatgtttcaatcttttagtgcatttcaatatcagtgtttttaaaagcaaaacagcagccaggaaaaggaagaaatgaaggtagtatttccctaattcccgggcacttcccccaaatagttctcccagactcagataaggcccttcaccaaatatattaatcataggttttcctccctgaaaaacaagccgccatgaccgcctttttctttcctaaggcgcatgatacggcagcgccgttggataattgtaagagcccgtttttatatgataacacatgatttttattaacgagtacagaacggtggcaccgtatgaaatcctcacccaataattcctgtgcatgttcaattgtatcccggaccgtgacttcggatccgtcaaaagtgtgataacagatggaatgggccactgtttttaccgaatccacaaaggaaatatccgggacctgaagggttactgcttcgtcaatgccgataggcagttcaatccagggaccaacttcctgcgccaaccccaaagctcctgtggacttgtcagcaactggttctgccatcacaagatatctgacatattctgcaaccatctgtttctgttccgggcgtttctcaatgaatccgaaggcccggatgccgcttcttaaaatctccattcccttatccccatggcttgtgacaaacacgacctttccctggggatccgcctgatagattttccgtaccagatcgattccgtttaactctgacttgcccaaatcaaaatcaaggaaatagagatgggaatcgggcgtattctgaatatagtttaataactctctgccggtggaggccaggcaaacgattctggcttccactttacttatactgattgccttatccaacaggccggagataagctccagggtgaaacggtcatcatcacaaacaacaatttttaacatgatatcatcctttttgtcagcatggaaatagtggaatgaatgttttgacatgctttagtataacaaatttgttctccggtgaaaagaagttgtcctgaatgaataaaaaatgtcctgaaccacagggggtatttacgattcaggacatattccagcgttctgggacggatttaacaaattgccggattcatgtgatatggtaagtccgcttgcaaaacagagtatcgtatggcggcaaagtttgattttaaattctaatcaaaataaggaaacagaacaaggagaaagaaaatgaaacgaacgaaagagttagtatccaggatcattattgcagcagtatttaccacaatggcggcggggtgtggttccaggcggaacacggtaagattggccggagaagacaccgtagccgcaggacagactgtaaactctgataagaatgcagtaacggataagaatacggtgatggaaagggatgcagtaacggaagaaaatgcagtaacagaagtaaaagaaagaggtctggccttcaagatttcacatgaatttactgaaaaaggggtggaactggatcactataacgaaaatgtaaaagggtatcggatgataaccatttcttattacagtcccacttacagaaagctgttggacgaggtgcttgacatggaaccggaggaaagaacgcctgagcggacggatcagtatacacaggaaatgcaggcggtcagcaggacactgatggaacttgttatggtggaaacagatacatatgagaaactcacggcaaccggaaaggttcctgaagattttacctacaatgcgccggctgaatggtttggaacaaatggggcgtatacctatattatctctattccggaattggacaatgggaagctgaatgaggcggaacagaaagaatatcagaagtgtaaagcctatatgcagacggtgaaagagaacctttcatttattccggttgagctggagagtaacgttacggtaatcggaaccagtattccttcgtttcagacagaagatttatatggaacgattgtcacagatgatatttttgcacagaagaagctgacggttgtgaatgtatgggggaccttctgcggtccgtgtgtggaagagatgccggagctggccttgtgggccggggaactcccggacgatgttcaaatcatcggcctggtaggggacattgagggaaaagaagatgtaaaacatctggagctggcaagaacgattgtagaaaaagcaggagccgattttgtgacggtgatagccaatgatgattttcaggatatgatggatggaattattggatatccaaccacattttttgtggatcgggaggggaacgttgtaggtgacccgattgtcggggctgacgtagacgcatataaaacatttgtggaggggtattttgttgagtaaaagaatgaggatgatgagaatgactgtacagtgtttggccggcctgctgtccgtgctgtttatgatttatggaacttgccgtggggaagctgacacggtgttaatcaaggccgtcaatatctgccttgaatgtattgggttgggatgaggtgccgggacatgaaagttacagatgcaatcaaaagaaagataattcagactgctgctttttgttttaccaatattcatccaggtaatttccacagaggaactttatacaccggaccctggaaacggttttgcaatcctgggctgaattgctactcctgtccggcagcctccctggcatgtcctatcggagcgttccaggcagtatccggctccatgaattatgattttagtttttatgtggcaggaatgctgatggcaatcggggttctgctgggccgttttgtatgcggctggctctgtccctttgggctgattcaggaggtaatccataggattccttcgccaaagcgtaagctttggaagggacttctggcggttaagtacataatactggttgtttttgtgtgtattcttcccataacggctgtcaattatatgggaatgggaaaaccggccttctgccagtatatctgtccttccggcactctgctcggagggattccactgcttggcacccatccggaacttaggcagaccataggagctttgtttggaatgaaactgttaattcttatatttacggtcattggatgcgtgtttatatatcgttttttctgtaaagcaatatgtccattgggggctgtctacggcgtgctcaataaaatcagtgtttaccatctggaggtaaatgcagagaagtgtgtgaactgcaaagcatgcatgaaagtctgtaagatggaggtcaatccggtcaggactccgaattcggcggaatgtataaggtgcggggcctgtgtttcgtcctgtccaaccaaagcgattcatattggatttggttctgctgcgaaatcaaacgtttccccacagcagcaggagcatggagcaaaaagactggcagcactggatgcggtacgcggcctggcagtgatgggaatgtatatccagcattttgccctgaatgaacgaaatggagatcttgtttctggaaacaccatgattttattcattctctgttctggtatttcttattcgattatgatgcagcggatgaaagagaagggaaccgatgcaaaggttatgaggacacggatactggcccgttcaatattgattgattttatgggttacattttgatcatgctgaacggaccgtttgcggtggttctgccggcttatgccatgctgtttataatggcgcttgtattgcaaccatgttcaaagcggacccttataaccgtttcgggaattttatatctggtctgtccgcctctcatgctgattgggctaagtttattttcagacgcagcattgctgggcgatcttgcaggcggtccgttgtctgctcttgcatggatgccggtatttgcggcggggatggcaattggccggtttgatcttcaggataaaaagctttatggccggtttgttgtcattgggctggcaattttgattccggctaaattaattgcctcgtttgtgcttccgggattgtatgaaaccgtcacaaactggctgctgcagtttccaagtgttacaaatacacagattgatccttacgccatctggccctataacacacagccggtattgtggcatatgctttttcttgcaatgccgcagggcggttcaatgtttgagcttctgattggaaccgggctgtctttcattatagtcgggctggtttttctggtcgaaaggaaatgcagcgcagtgctgattcccttttgtacggttggacgggcagcattgaccttatatgtaatccagtttgttattgcatggggacttggcgtggctggtattgatgtgaccagtgtgaatattggagcagctccatatggagatatactgattgctgcggctgttttaggtgcagggagtatgattgcgctttttccaaaggtttcccttgaaatactggtacgccggtttgaaaagatattttgttaaatcgaatgctggtaactcgatggcaggcagaaaagacacaggaagaaaagaaagcagaccacaagctgaacgaacggatggaccattggatgaaggaaattaccaaggagcagagagatgccatagaggattgtattgatgacatgctggatggaaatgggatgtgtcagctgtatctgtatgaggaaggggtgaaggatgggatacgattgatgaagatgattcgggatatgtgatagtatgttttgtggttagcgagtgtgtgaagaaaagtctgtaaaagctgatcttctatgataataactgggctgaaagttctttcttggaccttcagtccttgtgtaggaaaccgagaaatgggcccagcccgccgcagatattgcacccgccgtcaccaccgcaggtggtaagcctatcagcctgcaccacttcccgcatatagggatcgtaggcgatggacaagccgaagaagttgggttcctccatgtcatagggccggttctcatcctcatccatgtcctcaaaccagtgcagacgcatggagtagtctaacccatctccccatggaaacagggtccgacatccgccgccacacaggtaggcccactcgtccgccgtgggcagggagaagcccctgttttccagcatggcaagaagcgcatcgtagtctgtgcggttatagatacagatctgaaatccatcttctgtccgttctatgcgagctgactgatgcaaggtaagactgctgctgtcactccaggcaaaatcccggaactccttcagccagtcagggtgggcagtcagcctgggatcgtccattttgactggctcccagttaatttcctccagttcccggcccaccagcatggggccaatggccgcctgccgaacgggagccatactctctccaatgagttctgtcgggtcctgctccatttcccattcctggaacagatactccaattcctcccggctctcctgattcagtcccacggcaaactgctcccagcccagggtgacggtatcgccggggacaaagacgaactcccgaccatctttctcgaagatgccggtggtgcagctctggccccagtggtcaaaggtatgtagaccgagaaaggtcatagtataacgagcagccaggctttccatcagcgcctgcttctcggtggtatccatttgattgaattggggacgggacagtttttcgttcatggaaagtcctccttcgattcgttttgcgtgttccagcagatagctccgaccatcctgcttggcccgttccaagtattgtggaagcaggtcggaatggatggcatccagtgaaatcagaacggcgatccgctggtattcctgaagttcaggagagtaacagttgcgctcccaaaacagcggagcgaattgttccacacagtcaggacgcagagcaggcatcgccaaaagcgcccgccggctcacatattcattggggtcctttgcgaaatccagaattatatccctgactttctgactacatgagcattccggcagataggcggcaaactgccacttggcctcattctcattggaggctgcggccctgcggcagaggcactcgaaccatttgggatgggaagtggtttcctgtataaatccctccgcttcgttggccctggcaattaaatagaccatctcatccagcaggacgctgtctgccatttctgcattcatttgggtcaacacatggcaaaaggcatcaaatatatcattccacgcagggtaatcgacctcccacgcaccgccaatctcctcggtggtttttccgggataagtgatttcttgccactgatgaaattttcttgcctgcgccagcaggcactccctgatgtcctttgccatacgcttacctcacaattctttgcacaggtttcccagttccaatgcctgttccacaaggtccaggagcaggctggaaaaattctcggcaatctcctccagatcggcatagtcacagttatagccccggactctgccgctctccaagtcgataaatacgatactcccgtcacccaatcctccgattggaaaggtggggccgtggtcatattcgctcatgtaatcctcataagcctcttgaaaaatcgggtaggcttcttccaactctttcagtgtgaagatccacggctccgccaaatagcagccgccgaagttcaaaagtagccagcggtactctgcggggatgggagtatacctgctttcaaatcgtttcacagcatcctccggttctgggcaggtaccctttgtgaaggggcttactttataagcagtttgaattttactgcggtttttttccaaattcatgtcatgcattgtatttccctcacagagcatccaggttttcctgtaaatcgccctgcatcaagtgctgggcaatggcttggttcagtggcttatggggggtgataggctgcctgctctacatcgtgcaggcactcctccatcagtgcctccggagaaatgccttcccgtttgccataaagatggccgaaggcatagcacacggacttgagaaagccgaaaatatagtcatgatttccacgcatactgggcaggtcattgaacgagcccatgccgccgtatgcccgaagatggtgggcaacctcacggcgctgggtccagtcctgaatatccctctccagccagtcgatccagttttgaaattctggatggtctgccagaaggatggagcgcagacaggtcagagcttcggtataaatatctgtctgtttcatcagaaccctcctgattcttttaacgctccatcataggtgtggctttcccagatggcctcaaattccgctttctctatgacgcaggcgtggaattcctcgccccagacatgagcgttcagttcatctacggtggggatcggcgtgatctcgatagcgtcttcgtaaaggtcaggtatgttgtgggtgtgaccgtccataaagatgtcaatggagcggagagccagccgctcatttcctgtatccacttcatagaggatcaccgacggttctccctccggtgcgccctcccaaaagagtttgatgtactcgatcattccatttccctcatttgaaccaatgccaccccgtcatggtgccagttacttcatctatctgtaccgcaatatcataattgccgcgacagcccagcaaagctgtaggatggtcgttttccagaatcaaatcataaaactcaaccgctatgtcttggaattccttcggaatctccagtgcagagaagaaatccactgattgagcattttggaaaaattcaatggccgttttactgcattttactataatccctgtttgagtggtcaactctttcatgctttcgcaacctcgctcatgttcagatacatccccatcgttttttcattgtcacaggccgcccggatcattttggacagcagcatcaggtcatcgatgtattgggagtacacgcagaacacatcttcgtcggagtcgaagtgaaacagatccacgccgctgttgttttcctcgaactcctggatcacgccccggacaagccgctcccaatcctcgctgctgccgatcagtcccagccgtcggaattcctctgtccggaatccgtcactgattttcagcagaagggagatcgcataggggtggtggggaatgagaaagaatggcgcgatctgctccggcttcgcccaaattttgaagggcgggcgcgggtcaggtatccagggcaagatttcccattcgtcctccggtcggtttccgtattggcaaaggtctttcatagtgttctcctcattcgatgtcgtttcgttcttcttttacatccagtggagcaccgtccagagatgtgatctgtgccagctctgtttccgtcagatttttcaggaaaatgcaatattcgtccgggtggcctcccacaaattccattttaggcatcccgatctgctccgggtcggtaatccacaggcaaggttctcctgttgcccaaaaccgagtcagggtaagaatttggccgttgaaaataacttcctgttccatcctcattcctcctgcatttgcctcagcagcttcacgatccgctcccggttctttgcggttttcatgaaggtggggagatggtcagcctgggtcattttcgctcttcccggcggcttttcccgcaggtcggcgctgagatagccgatcagataggcaagatgttctcggttgagtgcccatacaggttttccctgaaatgaagtcaaaaaccatagttccaacccgaaataaggttctctcccatccctgatttcgccaatatatgaaaacgcctccgctgttttatgaacttctcccgacatggttttcccacaatagggacaggccacatagagaacggaaaagtgctgttttgctgtatcttcaatatccactcgatagtacctgccgcagtttttgcattggttatggacatcataacggtagatcgtccggtcgcgggtctcctgatggccgcagctcaggcagcggaaataggcgttgtcatcatccgctgttaccatgcccgtgccatggcacttggggcatttcacctggatgccggaggtcagggcgttgtatgcactgtatgtaaagtagggttcatcaatgattcggctcatgcgcccgcacactcctttcagaaaattactttcacagccgaaaccggaatggtttcaaatcttttgctttgattgtcagattagaaacgctcttttgcaggacctttacctgttccaaatactccgcaggtgcgtggatctgctccagatagcctgcatagcggataatctgatccagcgcccgtttcctgtattttgcgatttcccccaaatgggaataactgcggcctgacacatagcttggaacatcgatagaccgaattatttctatatcaagcgccccatgttcctctttctcagatttaatggtggacagcatatcttccacggaaaaacggatgccgcgctcgcagagaaaccgcagttcatcaaacaggtggttcgccacaaagtgttcagccaagggctcaaaaattacatcatcctgataccagccgccgtgggcgcaggagatcagttcacggtatcgcttttctgcgatccactggcgcagcacctctttgctcccacgcatccatgcgtccagtcggacctttgtttcttcgggactatcgttggatgttccatagcagggcagaccattgtctttcagccacttggtcactgccttgctgaatttcgtgtaactcaatctatttcccctctaaagtttcgcaatctcatccaaccagaaagtatcaatttcagaagcacagtcaagtgtctttaacagatgtttgtattcgctcagattgggattttcctcatctgcaatgatacggaacatgagagaaatcgtgtactcagttggttttcttttcagcgatgcgactaattcttcctcatagccctcatggtaaaacttctccataaagctacccaacggtccaggaccaccgaagtcaatattgggagaagattcaatcagttccaagatcggccttacagcatcaaacggtttttcgcactgttccagttcatcagtcaaatcataggccggatctataaactgatatttgtcgcctgtggtagcagccttgtcgattgcctgtttcagttcttccaacaattctgtaatccttgcatccatattcaagcctccttgatcatcagatttgggacagcgtttttttcatgtccgccaagtcttttccatctaaaccgtatgcctgctcaatcagattcgcataccgatctgcatactgcgagaactctgcttcacagtgcaaatcatacagcagcaggcagccgttgtggaatacaacaggatctggtttcaccttttctttctcgaccgctacaagacgaagcacctcatcggcaatggtacaccgctccgactggtctttgagtttagacaatgccattcgcgcataagcggcaatctcatcctgttcctgtagggcaatcgctgtcagttctttctggactaagaggagagcctttttgtcccacatctctgtgctgcgcagaagatctactaccagcattcttctgtgaagatcccgattttcccaagagtccagctctagcagcaaatccgtttgctttatctgatctggttcgtgggcccaatcaagcagctttacccgaaaaacctgataggccgacatcatttccatccatgccgagctatgatccctgctgaactctatcatgcaatgtcacctcctcaaaaatcacgaagttcctcaaacttttcaatcagggcttctttttggatcgcactgtccgggagtgcatccagaataccccgcagggccatgtagatctcgtcccgctcctcggtttcgataaagcccatcttattgaaggtctgggtgtaggctgccaccgcgtccagcgcctgagcctgggcgccctcgcccggctcagcggccagcttcatcagcagggagcgggtcttgcggtattgaccggctgcctttttcgcagcggcggcaggaatatgctccgcaccgtcccagccccggaagggattgtccaggttttgcgccagccactccggtttccggggtttggtaatccgcagatccattcccggcttgcttttccagagctgctttgccgcttttgccgctgtctccggcaggctggtcatccagaaccagcgaagctccggcatctgctctggggtagggatgtcgtccgccccgaaaccgaacaggtcgaaggtggataggttcgtcagttcccggacccctcccacggcggagaagttccccaggtttcccggcgcgccccagagcctcagctctttcagatggggatggacagcagccagtccggtcagatcaaagtccttcagctggatgccatgcagcccccataggttcggcagttccgtgtgcgggcaatattgcccgataaattggagggtcaaaccgctgccatcttcgggggcatggatggtacaggcgtccgggcccttgttctggaacaggagctgctccgtttcctcacccagccacagttcctgaaggccggtcatgtccagcatcagctttctgatgctggtgccccgcagatcaagtgtcctctgaccgtggttcagcaaagtcagttcatcgaggaagggatttccacgcaaaaactccagcagatccgggtgccaccgctcgcagatgaggtcggagaggcagggcagcgcctttagttccagcgccgaatcgaatggctcgtactggtccgtcacccgatggctgctgaccttcaccgggataccgccgatctccgtttgctcgtcgctctccatggcctccttgaaagcccgccgccgctcctccggaatctcctgccatcggatttggaggtacacatcatagccgtcgtcccagccgccgtaggagcggcagggctggtcggtgaaggacggaagtgtacccaccagcgtgtactggggtgggatttccaccggcacccgcagcagatgaaggtcacggggccagtacatgaagtccttgtagagcgggcggagatggggcagttcctccgccgtcagaggggtgtcacccacccagtccagagagaggatcaccgcccagggctgctcacttaccgagtccggcggcgcgatataggccacctgacaggcggtgtagcgtttcagatattggttgtagacggtataaacctccccggcattggctttcatggcgctctcctttgttctgtcacatttttaatcctgctctcgataactggcttcaatgtcgatgaagcgcacatacacggcgcagacttcgccctttgcgtcatagccgaagtagacgggatagtaaccgtcaccccagccagaggagaagatgggcaggttgcagtccgtgtccggcactgtccagttgagccagtcgccgcagtccccctgatatttggggtgagcttgggcgttttcctccagtaagtcgcagaacaggtcgttgtaggggtcgatgtccgggtcctcctccagccgcttggcccagtatatcttgaaggccgcctgggtctggatgtccgcaatacaccccatccctgcatccacgccgaaaccgaagtagtcgtcatctcccagcgccgcgtccagattctcgttgcccaccatgcccagctcatagcggacaggcttttcctgagaaaccgccaccttgacgcaggcgtagcggtcgccgtattgttcgctgggcaccacacagattttcactgggtaagttccggcggggatcgtttgaaggaacggcagagtgtcctccagctccaccagcggatcgcaagcgaagatctgcccggtggggaaatggacggcaccgatgtccagtacatccaccgccatgttcccaatcactttctctgtgaaatgggcctctaagtcatctttacaggtcagtttgttcttgattgcttcgtatttgttcagccattcagttgtaggcatatcagtttcctcctgttgattctgtttcttgatgtacacactctttgagccgtcccaatagcagttcacacaccggccatcctgaaaatgatggtcacaattcgggtagccatagagaacatgggcacattccgggcacagccccatcatctgtgaggagcctttgaaaaacaggcttccacactcatcacaaagggccagttctttttctgccatagggctcaccagtcccgttcccggatagcctcctcggtgtcaataggaatgccaaaccactccagaatgtaggccacggttgccgcgatacattcccgtgccaccgtttcgatctcgctgtcgtgctcgtcaaactcctcctggagatcattgatgccgcagaccgcctcgtccagcgtctcctgcaccacttcggtgtcggtttcgccgctctccagcagatcgatgaccttctgaagttcatcctttaccttgtccaccagaaaagtgggatagtaattgtcctgatacatctcgtccagcagtttgtaattggggtcaaatgctttcatcgtgatttctcctttctcattcaaacatcaaaccgtatgattcggtcaggcttccgtcgtcctcgtgaaatatacactgatacagaggctcacgctgggttgctttgcggaaccgctccagaaccggagccagcggctcaccggcagggatgccgagggcatcagacacccgttgcaagctgtccatatccatatcttccaagttacagttgcgctgtctctgtccatactcctccagtgttttggaatctacatactgctttgtgtcacagcagtcgtgccagcagatacagctcacaagcagggaaaagagatcatccatgctctcggcgagacggcctgcctccccttcgctgctgtaatatccaatggagccatcttccaacaggtggtattctccgccggagccatctctggcaaaggccatgccgggcagggaaaaggtgcatcggccttctgcgtcattccgcggggataactcatccagcaggaagaagtcaaacagcgaatcaaattcatccgccaaatcagggttttcatgcagtattttcaaataatccattgtcgttttccctccgtttacggttcttgggtcattttgcgcagctgttccagccactgtgtttcttcgatcatctcatcgttttggtaaaaatggtctttatcgcgggccagatgatcggcaagtagagccgcgtccacaggagtgcaaactgtaaaactgtcccgatccgcgcccttgatctctcggttgaggtagtacacccgcttggcatcgcgggaataccagtgcccaagcagttcccaagaagtcagttctgctttggaaagttgtttgccgtaggcatagatccgtttctcatccctggcaaaataggtatcgcccaacgagcggaaagaggaaacttccgcgcccttgatgatcttcaccttgccgtctccgttgtggaagtagacctgccggctgtcctttgcatatccctggggtgcacccgaatcgttctggccgttgtctaatacctggaaggctgccagctctacatctgggattctcccgctggtggtgtagacggctgttttgtccatcgcataggcatagtttaacacccgaaacgatgccgggtctgctccacgaaggcgaatcccaccaagaaagcaggccgcagaggatttgccccagtaatgccagcaacagaagtctttgggcgcaacacccttcaacaagccgttttcatataggccggagaaatagacggctccatcccgaaggaaaaattcgttgtccactggctctgtgttggtaattggttgcagcgtttcttcgtgctcggctgtgatgctcaactcgatctcatcgtcgctgtaaactaagtagagcccatgaggggcttttctatcgaaatgcagttcaatgtcacaatatttgagtatcaaaggctttccgccgcttctcatggtggaaacggcatcgggcttcccgaagatctctatgacctcatcctgcgacattccaaattttagcggtaaaatgtcccgcggattctgcaatatttgattgcgccaaatagtaaagtcctgtttcatagttttccgtccagtgcctccacagttttcatggcagcggaatcaaatttgcactgccgcagttcccgttcgattagggcaaacacatcggggaagcactcgatctcgtcctgatactcatatttcgcatacagtttcccgtactccgagatccagacctctgccgggtagtagtagccgatgtgaccgatgggctggcacttctgaccggcagcctgttcgatctccgccagctcacagccggacatatcccggaaataggcgtcctccaaatggtttttgatcccgttgaccaggtaagggaacaaagcaaactcaaaatccgccgcccatttcagctttttctgcgccaagtaccactcacagcacaggccgaaatacttgcggtaaaaccgctgggtggtcttcatcatcgggacgccatgatcggcgtaatactgctccgcaatggaaatatccacactgcggctttcctgccatccggcgtactccatcagctgcttgaccttgcttttgagatcgccggagatggggatgcgttctttgatcattcaaatcatctcctgtctgctgtgaatcaaagttcatgtggatacccgatcttatccagaccctccttgatttcttcccattcgctgcgtttcgggttcaacgcagtgaccagttcttttgtcactggcaccccgtcagcaagctggcgcacagcctccaaaggcagatcggctggataaaaccacttcccgtactccacatagctcaacggattgccatcaatcgtggagagcaaatccttggatgcgtcctcgccgtccatgggattgcagtgccatgtggtgccatcttccgtccagacgcagaaggtgcttttcatctttttgacttcacagctgctcatgagcttttgcaaagcagagggcattccatccgtcaggtcttcgatacggggaagtttttcctcccagtcgtagagttcggaatccacaccgttgatcacgcagccttctggcgcaaacatgacgatcatgctctggtcactgccatcagtggcaaagaatgcctctttgccttttcgccatgcggggttgtatgtatagtggcggatgaagttccattcctcctccaccatgatgatgtccagagctgccagccctttgcagaagtttttcaggcgctccgcattgggaaggccagataaatctcttgtggaaatcatgtggttatcctcctgtctttcatcaccacagtcggtcaatctgggtatatatcttattcggttctctgtccgtaaaactggtcaatgagtcggtggactccgtaagcggcatcacattcaaaatatccagcacataataccagattcctgtatcccagtcccggaaccgcccattgcagacagcccgaccataatcaccaggaatcaaatccagtgccagctcattgaggggctgtttctgcccggtcttattgtaggtatatcgctccggcatcgcaccaatatgccaatcatagcggtaacgcacctggattccggactcctgctgaatcagttcaaaagggtgaagtcgcattgtaccattaggcttccattccatcagcctacgacagtccctatcaatccgaaatccatcgggcctctgtacgatagatgcaaagtgagtaggtaggccaaaggaataataagagaagaagtctttaggcagccgcatcgctctgggatactggttccgttgtgcggcggcgtttccgccccggcagtctttataccattgcaggcggatctgctggatcagaagcgtgggcagatatttttctctttttctttcctcagctctcatgggtgatacagaaaatctccttgttcaagtcaaagtagatcaccatcagttcgtcagtaatctccggattgaaggacaggtccagaatgaaaacttgctgatccatctcgtcatccaccaggctgccgaaccgcttgagcttcaaaaagtctaccatctcggcaaaggacagcttggatggatcggttcccggaaagagttccgccgcaatatccgggcctacatcgtctcggtggaactccatgaaaaatgtcacaacgctatggtagcggctgtcctcgtccgccagcgccgctttgatggcggccttggccttttctgccaatttctccgcctcatccagcatttctcccaccgtatccatagcagcaggatcagcagtcagttcttcctctacatcaaagagaaagggcagtcccgattcctcgggaaagttgaagatttcctcgccgggcgtatatggtaaatcaatgcgtttacaattcagtttcatagatacacctcctcattggttttccagatggggtaatgggattggtgaatagaccactgtatctccgtcattatccatcttgagaatgatagcaaattccgctgtattgctgtcctgtccctttgggagaggacagatcattggggggcaacgcagggcagcatggttcgtggtattattccaatcttccatggcagcagataaaatgacatcaatgtgtgccaataccttctcaatggaacccactgagatgttgtaaaaagtggggtttttatgatactgctctgtgatgaagtttttataggtttgcactggcataaagcaaaattcccaatcaaggggatacaacccaagccaatactcatacagtttcatctctgcgcctccttatccctcaatgttggcatctttgacgccctttttcaaggagccgtagaccgtcacagcatggtcggtgaacatctcatcgcagtcaaaccaggcggtgaagctgccgccggaggtgacggacaggctggtcatgctgatccgccgggcaagttcttcctccgtaatggggtctgtttccggatttcggggggcttcctcatcttgggaaagccagttgttggccagctcggtcaggttctttgccgcaagctcccgcatggccttgtcccaggtttcacagtcggccagcagctttttggcggcactgcgggcgcgggtccaggagggcttgctctcggcattgacctccagggaaagaagcacatcctttccgcgccactggatctcaccctcaaaggcatcatggtccttgtccagctcgagctttcccagcacctggtcctggatcaccaccggcttgtggtactcgtccagaacggccccgagttccgggcagtcctcataggtcttgaccacctcagagatacaccagggccgcaccaccagatcctttgcccattcttctttcatccggcggatcttcaggcggcagatctgctcgttatgaaagcgtccccagcccttgtcgctgttacgctcctcgtcggtgaccggccactccagccgctcctctttggtgctgaccttgccggtgtcacagaacaccacgcccagtgtcacaatggtcatttcccaaaagttgcctttccagttatatccgcccccgatgcagcgattgatcagagcaatcacttcctgctcctcgggctcgtacatctcatagaattcttcaaacatagatcattctccttatcccgccgtttgattgcggtattccttctccagttgggtgtaccaccgtttcagcatggtttccagactggtttttcctttccgatcaaaaaaggcaaggaacttgtccagcaactcaggaaacaaatatttaccggtatttgtcaagtcctggttgatatagaccatccgcaggatacggccctgccggtccagagggttctttttcagcagttccttttcaaagcagaagcgcaggaataccacattctcgtcgtagaagtcctccaccacagccgcgccgatgctggtgtatgtgatgtcgtacaccaaacggctccaatcaaatttctcggcatagagaagtttcagcgccttcgcccaatgttcctccgggatcaccagcatcctgtgctgggcggtgctggagtagccgtggtagacgggttccggctaccccagcagttcactcacactgtcggcgtagacgaagcacagctcctcatcgaacaggccaccgatgaagttgccgttgcagtacagcatataattcttggactttgccggagaataagaaaggctatactcctgcgagtctaggcttttatgtaccttgttcagaaagtctatggatgtcatcggtttgctcctcctatttcaatttcagcacaaatccccagatgctcaccacaatcaagaggacacccaacagaaagaaaaccacacgccggtatcctctgctgcgtcgatgggcatcccgcgtaccagtggggtcgcagagccagttccagttgcggatcgctccgattaaaatcacggccccaatgagcaccgagacaatgtaccaatgctcttgcaaaaatgctgtgatctgtttgctgttcattctacttcctcctcacgcaaatacctgctggtatttctcttttcatactgtgcgactttttcaggtctgctgatgctgcatggatacgatatggcagtccgggcagaattccacatagagcgtgccctccgcacagtcaaacaccatatcccactggatttgggccagatacttcatgggcttgccgcagtgaggacaggtcgtatattccgcgtcctgcacccaattggcaaagccgccgatggtattcacatcctggcaggccgcaccgtaaaacaggggcacaggcgcttcgtccagcacaaagggattttccgtgagggccttgtactcctcgggactgacatagcaatccgtcttctccgcgccgtcaaatagctcagagggaaagacctccacgccgccatccagggtaaaccggttgaaggcggggcctttgaggaatcccacgcagctggggcagcaggtggcagtcaggataccatccaaccccagaaatttcagacgctcatcccggccgtccagcaccaatatatccaccatgcgtccgccgcagtggggacaggtatcttcccgttctcggccaatgcggacgggagatttctcgccagtggttcccttgaccataggatagcaggtgtcgaagttgagttggattttctggccctccttgtcgaaggtccagcctccgatctgcgcatagctggatgggtctacatagaggcccttgcgccagggccggggatttcgctccagctccagcagagtctccattgccttgtcatctccttgcatagcaaggcaactcatcaggttggaggccgcgctggaatattccgcggacaacagcgcatggatcagaccatcccgcacatcggcgggagcatgataatagatctcacagggccagaacacctctgcggccagtgccactcgctgaatctccggggtgatggcatcatggtagccaagcagctgccaaaagtcggcgaactctgggtcctccatatcagccagcctctggatgttctgtatcaagtttctttgtttttcgacaatttgttccggcgtccaggccagagcagcttgccgttcttgctcgcacttacatttccaacacaatccctcataacccaagggggttccacagctggggcaggtatatttcagactcatgttctcatactcctttcaggcaataaaaaagccccacgccgcactgtcataaagacaggctgacgcaggacatgaagaagccgcgttgaaggagccgcatccaccagcggatgtagtttcttcaactcctctctgctaatcggttctaagaggtggtcttcgagtagctgccttatgctgtttttccttcgctgtctctccatgagcctttcctcctaaaaaagaagcctcctccaactttccgctttcaacagatcccctccataagtcttcctcatcaaaatcagaccgccttactatttcctcctccaattccaatcggtcagcatatacaacctctcttgctgcctgttccgggacttcataaacctcctcaaaccggataccccatttaaaaaacaaaggaagtcttgttttcatagggcatacccctgtcttagcaagaatgaaattcccttttggcaaggtctttaactcctccggcgccattaatggtctgctcatcatctgcaggctctggctggggtcattttttcctctggatatagaaccagacaacaccgttctgtttcccaatgcttttgataagatttctgcgctctctgagtttggtgcaaaacctccaaacaaaatatcctggcagttatcgatgataatactggaaccttcttttccataattcttttccaactgcgcaaagctctgaatgataggaaccatgctgatccgtctggagcggcctgcagaaaacatcatctccatggattcaattttcggtatggttccgatttcatctgcaaacatcatgactctgttgggcagctttcctccatgttcatctgcaatcgtcaacatttctcggtaaagctgctgtaaaaacaaggataccataaaatacttcgtgttatcttcttccggcagcacaataaaaattgctgacttttccctacagaatgtttccgtgtccaaggtactctcaaagcacaggatctgttccatttcagaatccagaaacgcattcaatctggacatggttgtggatagcacagaggccattgcctgatccgcagaatttaaagctgctcctgcaaaccacttcgccttgtgagtaggtggcagcttatccataagtaactggaacaggctccggttcttcactggggatggcgccagaagatcctgaatcagcttgaacacagaaatgatatggcgtttctctggcgggcaatactctgcaatcaacagaatcacagaagtcagcaaaccttctgctgcatcatagaaaaaagcattttgtccataactgctggcagaagccccttcagagcagatgattgttttagctgtaattttcgcatacttctctgctcttgcctttgctgccagattttcaggattctttaaatactcatccatgtatttattaaccagcgtcaggatattgttgccatcagaacgggtgggatttcgtaaatccagaatggaaatctgatagccataatattccttggctatacctgcataattacgaaacagatcgcccttcgtgtctgtggtgaggaaactcattccagaagcacaggcatattcgatattagggtataagaagtttgcggtcttacccactcctgctgccccgatcatgagacagtgaatatctccactgtctaccagtgctgtgatgaaatttcctttctttttgtatccaactaccagcccctgctcttttggtagatgctttcctgctctccattgttccggttcatatggtacatgtgcatacgtttcccgtatttccttttccgttgcaaaccgtgcagttccatactgcccgtctcctaccgttctcgatttaattccgtttaaggtataatgatttgatatcattaccagactgccgattacagcgaacatccccaaacctatacaaataaatataatgactccctgtatcctactcccctcctctcacatcatctgtataactgtctgctgtctattcatatattccggcggtggcttcttcagctcttgaagatcctcattccaatccttaagatttgaaaaaagcgagaataccatatggtatccccgctcagacaggtttttctttatccgttcccttgcctgggttcccgccttatcatgatccagacataaagcaatttgggagatgtgcggtgcatcattcaaaagctgcatcaacgcatgttctgccaccccacaaagtgccacataactatgatccatccaccccttttgatacatggaaataaaagacagcatatcaatcggtgcctcaaatacatacacggtattactcttcccaatccaacgaaaactgtaccttggatcacatccttctacattccccttaaatggttgtcccttctgacaggttccccttttatgtgcatggcgtgggattccatctgaatcaaaccccacaaacacaacattatgatatttgacatcttcatagatcatgtgttttcctgcaaatacagatactactttaggatccacacaccttgtctttatcagatacgcaaaagcacggtgcatggtctgattcgcctctggaagtacgaatggctttttcggttctggttgctgattcacgctttcccggtatgcaactccctgttctccaccaagcagcattgtaactgcatccggaaagctctggttataaaacatccgcacaaagtcaatggcacagcctcccttttctgtcgcgtgatcataccatcgatttcccctcactgtaatactgtgatcactggccaagcgcttttctcttccagaacgaagcagcttttccccctgcctggaaagaaaatcttccagatccaccgcattggccctctgtttctgttcttccgtaaaataaacaaattctcccatgccatcctccttcgtcaataaataccttgtgccggctcctgatcatccctatgatgtccttgagcctgctttttctctgacagtttcctgcgtcgtttccggtcaatctgataccgcttcatttccattggtctctgtacttcttcgcaaaacagcttttccagatgatgaagcagtctggttgctgccagaaacaaggacggatcctgatatgcatccagatgttccagtaaaaaactggcatacagatttccttgttctgccgatgctgtcagatattccactgccttttcccgatcacgggaaacatctctgccacagagatataactttcccaacacatactgagcatactggtttcctttttccgcacatagtcccaggtaatgtactgctgtttccacatttttcgttacatgttctcctgaaagatataacttccctaactgataaaaggcccattcatttttctgctccgctgcctgttgaagccatttcattgccacttccacttgaggagaaaactcttcccccttgagatatagcattccaagccgatactgcgcatatggatttcctttttccgctgacaggctgagccacttcacagccgcttccacatccttcggtatttcctcccccaaaagcaacaaacatcccatccgatatgcagcatattcatttccaagttctgctgcagagcggaaccatttcatggcctgatccatatctttattaaaatacacaccatcctggtataatttccccaacacatactgggcggctgagtgctctgcatttgctgcttttgtaagccattccactgcctggccgctgtctccacttcccgtttccagccagagtgttccaagtgcatactgagcattgatattccccagctttgcagacttttcccaatacctggccgccccctcatcatctttgctggttcccgttccagtatgaagcatctgaccaatccggtactggagtttatcatcatgacttttttcttccagaaccacaaaaccggaatacgcattctgaaatctccactctgcctgctgtaaatccggctctgtaccaaaaccatccctatacatcttcgccagttccaggctggcataaggattcccctgctctgctgaactcatatatagagaaaacgcccgtatatcattttgctccaccccccggccccgccggtaaagcccagccagagaatactgggcatacttatgatccattgcagccgcctgagaaaaccagtgtgccgccttttcataattttgttctgctcccaaaccagaagcatacattttcccaatacgatattgcagatagggtttctcctttttctttacggattcttctcttacaagaaatgcttccaatgctttctcataccatttctgtgccagcccaacatccgcatcccgtcccaagccatccgcaaacatccggccaaggtcgtgcatggcaaacccattcccctgctctgcttcctgaaggaacttctgatatgccttttcaaaatcctgtaatgtagaatcgctgccatacaaataattcctagcctgtatatatccatctgtccaccagttggaactggattttccttttctgccattaggaaaaagctcttgcttgagttcctcctccgcatagtccgaatctagttcccctgtcagctctgctaccggatttggttcttgtataaaaaaatcgtcctttggttctgagtatccatcttcattctcttcaaacaaaaaatgatgactgccaagcctcaatgcttctgcaatcaccatatttttgatactttttaatttaggctgttttgataaaggcggtaattcttccgtctgttttcggtaggtcttcacaatctcatcctgccatagcccccattcccggtacagggcagacacccggtcatctttctccaactcgtctacgatgtgatcgaccagatccttcacatctctcttcaggtagccataaacctttttcccacctgtattctgcagccgtttagaaagctgcatcatactggtttcaatttccgaactcttaagcgtccccgcccgtatttcatctatccatgtcttcattacaacttccgaccgttcctttaaatccatacgagactgcgcctgttccttataaatatttgcaaaatcctgacggaaaatatcatgcgccagctcagaacgcatggcctcaatcgactgctttgtcagatacccttctccatcttttactgagtacaccaatagatgaacatggggatgatggctttcattatgaaatgcagcgtaccatttcagattggcgctgtcaattttcatatgcttacacagcattgcccgtttggaacgcagcaatgccatccactgaacagcactgtcataccctaaccgggctgcatcctcgcgccgaagggaaatcacatgggtccacacaattcccttgtgatctgccacttgattctgcacctgtccaagaaccaccggttctccctcatctgtaaacagaccatgctcaccaatcttttctacacggggacgatgcgccagataatccacataattttttcgcgtcgctgctatatcaagattttgttccaatgcacaggaaataaattccgaggcattttcgattgttggttttctttgataatcttcatactccagcatttcttttgtcgccggaaaatcctgcaggagctgatgcactaacttcttttgactcaccgttgctgggaggtgctttttacttgtatcaattttctctacccctttccgcgttccaatgtaatggacataattttctttctgagatggttttgcatcttttaaatatcgggaagtaaaaataagttttgtcatgttactcctttttagaaagcaaaaaggaacctatggcttatcacacaccatggctccttttactttttatcacatcttcttccgttacatagtttcaatatttgaacatatcatgtacattgcttgatccagtcagaaagaaagtccatctgctctttcgtatgaaaccagtgctccccgttttccataactgtaagtgttgctccgattctatctgcaaactcagctattgtttcatacgatgtcaggttgtccttttctccatacagaatgtgcgttggaacagtccaggtaacaggatgctccctcacataacaaagataagcccaggaaagtgtttccccaaaggatgtcgggatttctttctgtttctgcaagtcatcttcggtcacattcgcccactgcatcatattccgaatcaatctttccatgtctacaaccggagaaataaagtatgccttctctattttgctgtctgccaaagcactcatagcaaagaaagcaccaatgctgttcgcaatcactgttaccgtttcatatgttccgcataggttatcaaacaatctggggaactcttttttcgcttcccaaggtgactgtgaggaatagtcaaaaccaattacatcatattcttcaaagagcgctttataatactctgcctctttcggatttccacctttaccatgtatatacaaaattgccttgtccatttatttgttttcccttcgcaatacctattttttctttttgggtttgggcagcggcagttcatcatacatcgcgtggaacagtcctgtcaaaaattctttctgatcaacctcctctaccagcagcatctcttttgctccctcataaggtacttcatataccggatctgtcatataggcaattgctgactttgtgggttttacaagcagtctgtcatcataaatgcctcctacaatcttgccacgataataaataataaactctcccatcatcgtccgatatgtaatttcatccaactcggacagctgctctaaaacaaattgtaaataatttttacttgatgccatcgtttacctcaaaccaaattttgtgtaagaatacattacattcttaatgccctcgatgtttctcttttttctttttttgttttaaatcaaacatttttttctcttctgccaatttgtcttcccggcttttagacttacgctgctgtttcctttgttcctgctgcagctttagtgcttgctgagattttgttccaacgcccctatccaacatttgtttatgaatttcacgctggagcttctttgggttttttgttagttcctttgcagtaacctccacagatggactaaattgcaaacgatcatattcctttagcacaaactcccaaatctcatagtcctttggttcagttccaaatgttactttggaaacggaaagtttcccattttcaactctctcaaaaatacctacccaaaatggttcctcaaaaaacactgtcagcttgcctgtccttatactcatggcaatccctccttaatgattgaaatgagcaaagaatggacaacccggaggggcaggttacttaccctaatatgcaggacggccgggctacctaccggctctggtatgcatcactgcatacgttgcgtttttatctttacttttataatcaagcctcctcggccagattaacacatataatttttctgtttctgattaaaaccaactagtcttttcatctctaaatttaggcgtatcactatcctcataaggattataattgtttaagttacatccaaactcctttaatgattttattttattatctgctgtccatacaatcaaggacattccgtcaaattcctctatattcccattattcatttcatttttaaaataccactctacaaccgtctggttatctttatgaaagaactgcttgatcttccactccatcaccttgccacgtgtattccattcattaaaccaatgttttacaacttgacggttattatattttggactccagctttcagtataaatcacgtcttccgcaaaaatgtcatccataccaagatcctgttgtgtaagccacattttgaaccatagttgaatgatttgttctctctcattcaaaattctacacctcgattcatttcttagtatattataatcgatgagttattgcatcgtaaaggacaaatctattttttatctcttctgaaaattcatcacacaactagagggaagtacaaataaattctctttccatcgtttcctttccaacaatatctacacatcccgcttttgataatgatacgcatcttcaaacttcacagttccattgatccgtctcacttcatcaacacattttacgtgcagcctgtttaaagattcttcatccacatcatgggtgtaggcaattacctgtgagagcttggacaattccactgctatcttaaagtccatcctggccagacggttctcactatcccgaacggttcccgtaagcacagaagccagtgactgcaaaaaataattttctgcttttcctgcaagaagataccccatatagaatttaagtgcttctgctacaaattcgtttctggaacgcacattggcagtctccaacaacccgtctgcctgttctaatatagctttttcaatataaatcccaacacggactttcgcattttcgctccccatcgttccctccttaccaggtattcacaaactctctctcatttcctccaaaatcctgccactttcaaaaatccagcaccattctttcgaccgccttttccaaaagtattcaaaccagatttcccgaacggctttgccggtcggtgttttccaggggtaggctgccaaaagcagcataccccctttaacctgcacacgtttcgaccctgccaaccactcaggaatcccatatcccccgtgttcttgctgtttccataaccttctctcacatttgcccgacaccgcttaaaatcctcgtatgggtaccacgatgccacctagctgtccaaagcccgacacaggggcacacagggggctacacggggatgtcatggatgactggggattccgttttctttattctggttatcatacgatttctgattcttccagctgggactcctcccgtcttacagtccgatcagctctacgggtacgttctctggtggatatttctcttgccaccttgtcatcaatatattcacgggtagcctgcgggacatatttttcatacagtttctgtactgtatcatttaattccccctgaagatcggtgtcccttttttccatgtggaactttaacgcatccaatttttctgtgttaaaactgacattgatcgtagtatttctcatttcaaatctcctttttctttcagaaagcaaatcaggcggctgctcacacagccgcccgatctcgtttcatcaggttcttaaataatggattagttcaatggcatctgcaagacccgccttataatacctcaaacgctcctgttccggtatatccattttagccataagctggtcatccaaccattgccggtcatcctctgaaaggctattgagaattcgatccatgcggaggacatgttccttggtctctgtgcaataagcgggaaccttgtcctcttcactttttctcttcagctccagaactcgttcttcgattacctgatttaactgatccataatctcatccatcggttacttccctcctttcagccacacacaataccgaacttttttctaaaagtcgatatcacatatccataaactgtccaggcaaatctgcacaaatttcatttttagctgcctcattccggaatagttgccagccttccaaaagcatacagatggctgttccagtaaggagaagtaaggtccgcatagccaataggcgaaccacaatgcagcatcctagagcctccaacataaatccccacatggctgaccgcccctgcagatgcataagttcccgtaaaaaacaccagatctccgggtctagcttcctctcttgacacaatcgcacactggtcataaatcccctgcgctgttgttcgggaaaggtgatacaccccggatctcgtgtagacccaacagatatatccactgcagtcgaaactggtatctggagaactaccaccccatacatagggataaccaatataacgggttgcctctgccatcagcgcggaaaaactcccatctcccatagcctgtccgggaggaagaccatttccacctggtacactcacaccgtattttgccagcatatagatgcgctgtacattcgttttatcttccagagaaacctcctggtttaattctgcagcaagatttccgtagaccatattcaggctttggattggaactacaaccgtataggtttctccctcttcatcctccctctcctcatactctacaaaacaatctgcgaatgccctgtagtccccctcatccatccgagggtactccttaccaaaaaacagggcataaaaaatcgcttttacttggtagggatctacttcttcggcttctgccataccattgatttcatttaaaaccccatccagtttttcaaaactgtcctgcatattttcgatgtacatccgatactctgctggcacctttgaagacaaataccctccatgaaaggacagctggacagcggaaatgttatgatctgcagtcccagaaagcgtacacataatcatggtggcaattaaaataacaggggttactaatgctgcaataacagaaaaaaccacagtcctcccatttcggccagaaagggtaagcgttgccagttttgctgtcacagcggcagctgagacggccataaaatcactccttccacactttttatcgagatgtttatctgacacatcaggatttatttcattccatcatagccccccatatgaaacaggctctgctgatagaagccttcctctctttcctgtttctgcacaagctgataagcgtgttcgattgcatcttccagaaactgggtttcaaaccctgccgtttcgtacccttgccagattacattggcataatggtcagagggaattccaaatgaatgccctggtgtcatcacataaaccatggccggaacaggatgttaggagggatgcagaatcaacagttttatttcatgggttggcggaaagaaagcactccgcagcctgatttacacgatgtttcctgcaagttatgaccggtacattgaggtgttcggcggaggtggttgggtactgtttggaaaaccaccagatgaccggtgtatggagatttataatgactataattctaacttggcaaacctgttttattgcgtcaagaaccgcacgggggcattccttaaggaactcggatttcttccgttaaacagcagggatgaatttacagtaatccgtaattttattgaaaagcaggaaccggatacccggtttttaattgaggagctggagctggcagagaagcatctgatgccgccggattatgaggaagtgaaaaaaatcttgctggaaaatgcagaggtaaccgatgtaaaacgggcggctgcattttttaaactgatccggtacagctatggaagtggctgcacgtcctttggctgccgtccgtttgatgtgaggaactgctttgacaccatttggcaggcatcccgcaggctggcagataccgtaatagaaaataaagactttgaggcactgattcggcagtatgaccgggatagtgcctttttttattgcgatccgccctattatgagacggaaggtcattatgcagtggtattccgaaaagaggatcacaaacggctccgagacactctgacagggagcagggggaagtggatggtcagttacaatgactgcgatttcatccgggaactgtatgcaggatattttattacagccgttacccgcatcaataacctggctcagaggtatgagggcggttgtgagtttccagaggtcattattaccaattatgatcctggtgagagggagcggtcaaaaccaagacagctggatctatttggaatgtggggagatggagaaacggatcattatgagatccgggaagaaatctgtccggaaagagaggtgctatgagaacagaaaacaagagaaaaacaatggtacaaaaaaaggaaaatggtgtcctttctgtacctagtgaactgttactgacggctgggattccgcttgattgtgatttgatgatagaaacagtccccggagtgattctgattggtattgaggatccggtacagacggtttgcgaaccttatctgaaggtgttcgatgagctggggattgaactcaatgaagtggaggcattgatgggaaaggagaaaaggaccagatgagtaaaccgatgtatcgtttagtggatggaaagggacgtgtcctgattccaaaatctatgagggaagcggcaaagctggagtatggggatattgtttgtctgggaatggcgggtggaaaaattacagtccggaaggtagaggttatcgaagtgggagatcagtctccggaggcagtggaggcatatgtccgtactgcatttcagtttatgccggacagcctccgactggatctgatcggagaactgagcagactgctgcagaaaaaggaggggtaagatcatgcaggaattcacagaaaaggattgtatgcagacagaaaaggaggcatctatccagaaccgggtggtggttcttccctcaaaggtattaccagagcattacacggggcagctttttttctgtacgaatatccagaaaacagaaaatcccagacattccattgcccatctggtttccttatctactggggaggcatggcactgctggaacagggatgtggttggtgtgctgcggccagaactgttgggggaaaaggaacggctccagctctcccagatccgtccatttggggcgctggatttacatggacattccccagaatattctggatacagttttctgccggatggacgctatgcgtcaggggtatggctggcaaatccagaggaagtatggagctatgtaatgatgcagaaggactaccagtatcggattttgatctgcgacagggatgattttgccgtactggaaatgttagagggaaggatgatctttcctgatgtgcagagtctggaacagtttcaacaggcacagaaggacggggggatggagatgatttagaaatgagggaagggaaatgaagcagattcagattgaaaatggagtgatccggtattatgggaaccgggtaggtcgtgtgacggaaggatgtgcagtagtggatcccatgtttcagaatgaagcattagaaagcttcctgcgtaagcagaggaatatccaaaaaattcagtggcaggacgggatctacgaccggttggcaaatagtcaggaagatatggaatcggcaaaggggttaaaagatgtacgcatctggcaactgagaggagatgtggatgtgcatatgaagttccttgcactttcccagatggagcagcaatatggctcccccaagccggatttttatatcaaagtctatgaaggggcatctgacaccaatgacctggaagaactctatgataaattccggtatcatccgccgtccggttatacaggtcatgggctatccattagtgatgtgctggaactctatgatgaaacagggagttcctttttttatgtggatcgctatgactttaagagaattgattttacagagtcgcaaccggcggaggaattcatacacaccatgcagttttagcaggcagttttggctgcctgtttgactgaaatagatccagaaaggaacggtttatgagcagaaaaaaacaaaggaggaagaatcagtatgccagatttagacgttcggattacatctatgtatccaccaggagtacagggcgggatcagagcctatgcatccgccacaatcgccgggtgttttgccgtccggggaatcaaaatcgtcgagggaggtaaggatgggctttttatgtctatgcccagtcggaaaacacaggatggatacaaggatatctgttttcctgtgacggaggaattccgcaacgagctgaaacaagcggtattgggagcgtatggagaggcactgtccatggcacaggcatctaccttacagacagcaccccctcaaaatccagggcagaacatggtctgatttaaggggtacagagaacaaaaacagaaaatcaatggaggagatcaaatgaagaatattaaaagacagctggtaaattatcgaaatgcaatggttatgcatatgtggaacgtaaaaaacaagcttcagaatacatctggtgagggatatgtggacacagccattaagatcctgatcgcagttgtgctgggagcactgcttctggcaggtctttatgcactgtttaatgataccgtacttcctacactggtacgcagggtgcaggaaatgtttgattatagcggttgatatggagatcaggatatcgctgcttcaggcggtacaggcagtgctttttttctcgctgcttattgcggtttctgcctgggatcttcggtaccggattattccggaccgattccaggcagggattgccctgctttcctttctgaactttgcacccagacagctgtttggagctttaggggcagtgccatacctcatagttgcattattttgcaagagggaaggtggaattggcggcggtgatatcaagctggcaggagcaaccggcttggtactgggacttcctgcaagcctgactgcttcctgtttaggactgacaggatttgtgatgtatggttgtatggtctgcctgtggaatcggttcaagggaaaacgagataaagaagcatttcctgtgggaccgtttctggcaggaggagcggcagctgtttattgtatgagattaggaggatggatgatatgaagaagaaattatggatcatggtttgtgttgcagtgccgcttacaatgattgcggccatcatataccacaacagaaaataggtagacagcagtcagtggaacactggttaaaaaggaaccaaaataaggaaaagagttggaggagatgaaatgcgatttttgaaaaacaggactgtacttggtgtgctttgcatcgtgctgtctttaatcatctgctttgcagttacaccattgtttaataaggctatgagtgaaaagacggaaattgtccgtgtagtaaaaccaatttcagtgggagaagaaattacttctgacatggtaaagaccatagaggttggcagttataacctgccagatgatgtagtaaaacattcggatactgtggttggggcatttgcatctgcagatttggcgccaggagattacatcctaacatccaagattgcagaagagccggcggcagaaaatgcctatctctatcatctgacaggagaaaagcaggcaatctctgttacggttaaggcatttgccaatggattgtctggaaagctaaagagcggcgatattgtgtcagttatagctccagattatagaaagcagggaaaaacggtaattcctgcggagcttcagtatgtggaggtcattgctgtgactgcaaacagcggatatgacgcaaatacgggagaagaactggaagatggagcggatcgtgagctgcctggaaccgttaccttgctggtaacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactctgataaggagccagaggaaaccaaagcagaggagcaggaggagtacgaacagggcgaaacagaggaaagcgaggtggagtaagccttgaattttctgaaaaacagtattttcagcaggggagccggggacagctctcctgactgggaaccggaaaatgagaatcaaatgctggcagtctggggaagtcctggatctggtaaaaccacgacagcagtgaagctggcggcgcgtcttgccatgcagaagaaggatgtggctctccttctgtgtgatatgaatacaccgatgcttccctgtatctgtcctcctggagacctggaagaggagcattctctggggagtgttctggcagcaacccatgtgtcggaatcgttggtacgccataactgtattactcataaaaaaatacgccatctaacgatccttggaatgaggaagggggaaaatgaatacacatatccaccttacgagcggacacaggcagaggaattactgcagtgtttgagaaagatcgctccctatatcatcgttgattgtggaagctgtattgccaatgacgttctttcggccattgccttgatggaggcggatgcagtgctgcggctggtaaactgtgatctgaaatccatcagttatctttccagtcagcttccgcttcttaaggacagtcagtgggatgcagaaaagcagtataaagtggccagcaatgtatatcccaatgaggccagcgaacacattgaacgggtgctcggcaatgtggcattccagatccctcattccgaggaagtaaaggcacaggttctggaagggaaccttctgaaagaactggtgctaaaggacagtaaggggtttagaaaaaccatggaagcaatcacaaaggaggtgttcggatgttaggggaaagacgcagcaaagccgcgttttctgcgggttttcccgaagctgttcgggaagaaacacgacaggattctggacatcttccggaggagatcatggaaacggaggcttctttggatggcttggatggaggggaggggacagaagaaaacttccaaaatgatagcctgtcggaacaggcttgtgaaggacagatgcatggaaaggaggatatctggtcagaagaggaggacatagaggctcctttgtgtactcaaaaaacgggaggtcgttctctccgtacccatgacctgttttttgcatcggaggatgaagggcgtgactttcagtccgtgctgcaggagatacaggcgtatctttccaaagaatatagtaatctggtaaccggagatggaaacgaagaaataaaagcacagatccgccgatttgccgggaagtatattcaggataaccgtatacaagtaccgggaaaaaccacggatgagctgattgatgcgatttattcagaaatggcagagttcggttttctcacaaagtacatctacggggaagggatcgaggagatcgatgtaaatgcctgggatgatgtggaggtccagtattctggtggagtgacagaaaaattgaaagagcattttgaaaaccccgaacatgccatcaatgtcattcggcgtatgttgcatgtgtctggaatggtgctggatgatgcgagtccaagcgttctgggacatttaagtaaaaatatccgtattgctgtactgaagacacctcttgttgatgaggatgtcggggtggcagcttcgatccgaattgtgaatccccagagcatgaagaaacaggactttataaagggaggaacggcaaccagtcagatgctggattttttatcggagtgcatccggtatggaatctctgtgtgtgtggcgggagccacaagctccggaaaaaccaccctgttaggctggcttctgaccacaattccggacggtaagcgtatttacagtattgagaatggttcaagggagctggcgttggtacgcagaaaggatgggagggtagtcaattccgtgattcataccttgacccgtgacagcgagaatgagaggcagagagtagatcagattgcacttaaccgcaaactgtacatacccatttcttcataatcaatattctccttttcctttatagggtttaatgtgaatcctcagaggattcatgtatttgttaaattaataatagtaattgttactgatattaatataaactactttagatggtttgtcaatagatttttgaaaaaagtttaataaaaagtgtaagaggggaagcggggagaaggactggaaaaaaacatcccaaaacgcatggtaaaacatatgataccggaccggaaccatatgttttaccatgcgttttgggatatcttcatattgtatcgctgaattatatcactgaatcatatcatgcatgatacatgttctgctaatcaaaatagtcatctggttttaggctgccctggtccaggctgcccagaaagcggcccagcagtgtgctgaattccctggccctgacgccgtccatgtggccgtcgtagtcccagtatccttccatgctgcggtccataagctccggcttcatataattgaagttataatattccagaccgaggccttccataaggtctttgaaatattggtgggactgcgcgtaggaaccggcaaactggtcaagtgtctccctgggtacgggagtggtgataacagtgagctcaatgttgtttttccggcagaatgaggcgatacggtcaaagtaacgttctgccctgggctttacctggctctcatcccaggggatgttgttgaaggtgcccttatcctcgccctccacccggtcccggtagatgaagccccggcctccgtaatgacctccggggatttccagaatggaagggtcgtaatttttgtaggaagaactctgcttccggcgtatatggtccggaatccggccgacaaggttgcggtaatagctccatggagccagtgcagagcggaagtccaggtttatgattttgtccaggaagtaggcagccttggacctggagagcggaaactcctgataaaagaatatctgggtggagccgctgcgctgttcattcatccagtatgaagggtccagctcatatacaacgcgggaaggcgactgcgtctcgcaggccagtcttaacatgtagtacatatcgtccgggtaggcgtctgccatgcagaggctgacagagcttccgccggatgcagcgtccacggagagagggtctataccgtactgtccgtgggaagttccgataaatatggtgtcatatgtctcgccgtttctgaggttatgaaggttgattctcacggagctgggagggatgaacccataattgagggctgccgtgatgcatatgcacagggccaggaacaggatggggctcagccgctttaacacttgtctgccgggccggtcatgggactgtctgtcagaccggccggccggtttgctagaattgggcatatataaatcctcctcccgtcatagtaatctggcccagcagcggtatggaaaagagcagcatcagatagacgcaccacctggcagccaggggtttcccggccagggcagccctcatgtcaacctggttttcctgaagcaggctgaccgtgaacaggactgcgcaggatagggccagggcagcatagtccttcaggtccaggcccagccttaagaggctgccgtctgtcagcgcggaaagggaaaaaccggtaatggtattcttcatcatggtcagcgcggctcccaggctttccgccatgtcaaaataccagctgatattcacaaggataaaggttctgaaaatccggacccctgcccaggctctggattccagggggatatgcagtttccgggccatttccccgtagatgggagccaacaggctgctggcggcaataatgcctccgttatagagtccgtaaacaatgaatttccaggcaggtccgtgccacacgcctaccaggaagaacaccagcagattggcaatacaaaccggcagtaccctgcttacatgctttccgaaatgttttttgcagtactttccaaaccggttcatgcccttagacagggaaaaaggatagaatacataatccttcatccaggtgcccagggtgatgtgccagcggtgccagaagtctgatatggaccgcgcaaaataagggcgtttaaaattggcgtccagggatatgccaaagcactctgaggcgcccataattacatccatgccgccggagaaatccccatacagctgaagggaataacacagtacgccggctatgaccgcgatgccgtggtaggactggtaattgccaaagacttcattgacaatgaccgcggccctgtctgcaatgacgattttcttgaagtagccccagagcataagctggagccccctctcaatccgggtaagactgaatttcctccggccgaacagctgtgacgacaggcggtcataccggccgatgggcccctggagtatctgggggaagaaggagacaaacagggcgaaacgcaggggattgcggtccggcgcatacttacccctgtatacgtctatgagatatcccatggactggaaggtataaaaggatattcccagcggcagcaggagccttgccggggaaatgtgtgtgccaaagaaaagatttatgttttcagtggcaaaattccggtattttaatgctgccagaatgccgaaattcaggagaaggaccagggctgttatcccctttttgcgctgtttgcagcgccctttcatggcctttttttcctccggggaaaggggctgtgcctggctgtcagggcccagggcgcgggcaagcctccggtccgtgtgctccagccacagaccgcccagaaaggtagtggcggtagtggtcaggatgaacactaccgccgccgggccggaggccagatagaatatataactgaatataagcagccaaatccattggagccgtccgggtatcacgtaatatcctgtcactgccgcggccaggaataacaggaatttcattgaaagaaaagacatgacctacccctttagttgtccttaaggcgctctaccatgttccagagggcctgggcagagttgaaattctccggaacaatgtccaccggagatatctcaattccaaaagcatcgtttaattcgctaacaatggacaggatatcaaaggaatccaggtagccgtcgtcaatcaggcccgtgcatgtcctgaaatccaccgttggttttatgtcttctaacagttcgaataattcatccatatgattgttctccttttatgtgtcagagcgttttgaagagccgctctgtgattgatatatctgcgcggcagagccgtcgttcagcatatccgtgggcaggacatcccgcaccagggaaagcccctgtttttgcgtataggtcaggaccgcgggaagctttctgctcagaaacagataaatgccctcggtcacggaataggccccgatgcggtcaaacaccagtaaatcccctatagtcagaccttccagggggaggttcttcaccagtatgtctcccgaggtacagagggagccgcacacggtccagcggccgctggcaggcgtgtcatcgccggggggatgtccggatgccatgaaggttttgttcccgtccatgacaatagcgccgtgttccggtttctgccgccgggccggattgtcctggggcaggtagcggtatgcaggcaccttcatggccatggtctggccatagtagttgacatggttgatgccgccgtccacaatgcagtaattctggccaaggctgcgctttatatccaccacacgggtcagatagctgccgcagggagcggccaggaaacggcctgcctcgagaaagattatacctttaaaatccagggaatcaaggctttttttgaattcctgcaaaagaatttcttcatccggctgttcctgcccttcaaaatagggtatctggaaacccggtccgtattccagctctcggaactcaaaatccagctgttccctgacaaaacccagaagtaagtccagcttttccaactccttctttatccgttccagaccctttttctgggtgccggaatagtactggagacctgtcaggtccaggtggggataggagccgcggttacggattgaggcaaggacatcctcctcatccataccaaactggttgccgctggtcaggcgcagaagcaccctgacaccggtcagcccggctgcggctgcgcatgtttccagcagcaggagctggtttagggattccgccgtgtaggtgcccgcaccctgctctgccatgactgagcggatgtgggcctcctccttattgacgcctgacagaacgatattccgtgccggcacatgggcgcggcggcagatggcatactctcccggtgagcagacctccagcccggctgctgtccgggctgcggcagctgtcagaaaggggttggccttcatggcgtagcagatgtttacctgttttccgagaatctctcccatgcggtggatgcgtgaggtgaatgcatccaggtcaaagagatagcagggggtattatattgccgggcagcttccagcagggtacggttattcataaagcctcctgagtgcctgccggtccaccttactgttcttggtaaggggaagctttggcaggtttctgtatagattggggaacatatagcggggcaggaggtgttccaggcccagtgctatatcccttttgccggcggttccctcataaaaggcagcaattttattcttctcctccagaaacaggcacaccgccctgtccacaccttccacggcttcaagggctgcctcaatctcgccaagctcgattcggtggcccatgtgcttgatttggaaatccttccggctgctgaaatacagaaggccgtcctcaccgtagcaggccaggtcgccggtccggtatatagtctcctgatagcaggtgtttaagggattctggacaaaggccatggcagtgcgttccgggtccctgtagtagcccagcgccagagcggttccggccacgcagagttctccgcactgtccgggttctgtaaccagcctgttgttttcatccagcaggaatacggtttcgttgggaaatggcttcccgatgggaatgggggttccgggctcaaagtcccggtccaccacgtagtatgtgcagttgcaggtgatttccgtggggccgtacaggtttacaaacagggcctttggcaggtaactgcgccatgtgttcagatgtttgaccggcataacctccccgctgaaaagaattttattcagatgggatggcacacggtaggtaaaacccttaagcgtggtgatgatgcacagggctgagacagcccagatggctgtggtgattttcctgtggcacaggtagtccagaagacctgtggggatggaaaacagccgtttgggaatgatttccagcgtggccccggtactcagggccgagtagatgtcctttacagatacatcaaagtcaaagggcgcctgattgccgatgacgtcatcctgagttatatggaacagctccgtaaaatgcccgatgaaatcaatgacagagcggtggctcaccaccacgcccttgggcacgcccgtggagccggaggtaaagattccgtacagggggtctgtgtcgacggcctgtgcgcggatggaagcaaggagccccggattcaggacatcatccgtaaggcatctcagctcctccagaggcagtatttcacctgaaaaggtgatatcaccggccaggccaaggctttccttatcagcaatcatcaggtctgcctgcagggtatccagaatgcggttcaggcgctgggcaggctggctcccgtccagacagacataaaaacagcctgcctgcacaatgcccagaaaggcgcccagggtaaatacattcttttccgccagtacgggaacaggacggcgggggccggtctttcggcccaggacactgccgattttcatggacaggtctgtcagttcaccgtaagtaaggcttgtatgttcgtcagcaaaagctgttttacggggatgggcttctgcggatttttccaaaaaacataggacattctgtatcaatgaaaggacctccgataacaggattttaaagcattttcgtgcttagtctagcacagatggatagcgggttcaaggctttaattatgaagattctatgacgattggcggatacctgcgaaactgcaattgccggatacactccgggacagcagattacagacgcaaaaaaggagaagagtgtgctcttctcctgattctgtaacagtcataggccggataccggccgcttaattaaccaaagtatctgttaagcagaccctcaaatgccttgccgtgacgggcctcgtccttggccatctcatgtacggtgtcatacacgcttcataaaatttctaacatactctactgcagtcaggttggaaaggaacagataaaattcatccagactggctgccgtattgccttgtgtcaaaagaacatcgctcataaacgaaagcacattaaaaagcaatgcatttttaaggctcctgctggcctgtaacagtccttttaccccaaaagtaatgaaaccgtcatctgtgatattggtatgtccattaaagaacttgctctcagctcccacacacatagaattcagcccaagaagaatactctgaatcatttctgctgtataaagctgtcttctgttttcgtcaaatccctgatattcttcctcaatgaacgcataaagatcagagagaactgggtaatcctccgcagccaggcattcaaaatcactttcgtctgtaatcccccatctggtatataacttctgcagcatgatctcaatcacatcgatttccctgtcggaaaaatccttgtagcttcggaaaaagtcctttaagaaactgatatgctgggataatctggaccggatacgaaaggtctgaggtgcatccagatcctccgggcttcccgcttcgtcccaggttttcggttccagagggttgataatgaactccccactcattaagtcgataaaacaccctcccagattattggtcagatcttcatactccatttccggatccagagcgcagatatgcattccggactcccttaaattcgtcagcagcaatttaagcagatagctttttccctgtccgctgtttcccagaatcaggatattggcattcgtcttatcatctgctctccggttaaaatccaccagtacattactcccaaatttatctctcccaatatagaacccgtgaggatccgtctttcctgaatagttaaagggatacagattcgccacactgctggccggaagcactctctcaaactgatccttaaacaggttataaccgcttggcattacacaccggaacccctgttgttgacggaggatcagtcggtctacattcaattttgatcggatcagttccgttagtacttctgtctgaagaagcttcaaatgctccagatcatgggcacacaactccagatatactgccgtatggaggaggggttctcggttacggtgcatctgggctacgatggtagttacatcctgtaaattactttcagccaaaacagtctgctgtaaatcactggtattgctccgatccatccggtttttgttggctgcattactgatgatcttccgctcctcaacgggtgtcacatgacgggtatagatccgcaaggttacaccatctttctcccctaaatgtgagagaattgcctgctcttccgtagcagtcgggtactcccgcagtgcccagacacaacgatatgtgttaccacaaataaaatgatctgtttcaaatttaatgacagacggggcaatcatatccagaaattcctggatacgcacattatcttccctgtcatcaactgctgttcttccttttttcaagtcatctcctcctcactctaaatctctggtatgatccaccgctccccgtcaaagtcttcaaacttctctgtggtcacgttctgctcatagtaaacagccaggatacgtttgatatcctctttatctgcccgtttaacagaaaaactctgttccttcagggatttttcaatcctggaaaggtacggaaaaatatccgattccttttcatcttttaaccgcagcataatcagaaattcacgggctgtcgccatctgcacctgaatccggtccagatgggtctgatcctgttccaaaagacggcgtatgactggattctcttcctgctccatctgacttttcagaaaccgcttgttgtcttcaaaactttccctgctgtttagacacagcatctcaatctctgccactccttttagtacagtcataagagcatagattcttgccccgacactagattcggacaaaacagaaatattcgttggttttacaataaaatacaccagctccccctgtccgtaggtcaccagactgtagtctgtaatctcctttgcaccaatgaactgccgtgtggagaggcgcttctctgcctcttttttcgcttttcgtttctccctgctcattcatacctccactcaaaaaattgctgacgcataaaaaaatacgcacaggcataccggataaaatccagaatgctggtatcttcaaaacggatcgtcagaaatccatatacccctgtcagaacacaagggaacataaatcccgcctgcgtagctgctaaaatggagaccaatccgcaaataccaagaatcccaatgtcccgaagctgccataaccaaagtgttgcttttgatttcaaatggtccggataaatatacaaccgatcacctccaaataataaccgccggcatgatgaagctctgccggcggtatgttcgatccttcctcttattcagtttcctcaagttctgcctttccctctgtctcctgcatctctccagatactacatgttcttcctgcgaaagtacatcttcaatcagtccgatcacaaattctttctggctctgtcctgtctttttgaggtatttttttaacctctgaaaaaactcctctgatacctgaaatgccagtgtcctggttccgtttgccatctctctttctcccttctcaaagtggtcttttagaatccgttccatatactcgttcagcttgattccccattcttcctgttcttcccgaactttcttatgcagggattctggaatcatggcgcataaatttttcttacgctcttccatttgactctcctttcctcgtttttacaaaccaagtatatccataaagagatgagatagctatgacgatacccaacaaagattgcctgaaaacggaagcagaactaccaatcttatggttctttctcctccttcatcttgcgcaaaaaataagcgataccacggagaacaaaatccacacacggtatcgctacgctatttccaagagctttataacgggcactgtccgaggcaccagggatatctgtccagtgatccggaaaaccctgcaaccgttcacactccaaaggcgtcagtctccggatcagtttccggttctcaacaatacatttatcttcgctgacatattgattattaatccccttatgatctgtatatccaatggttcctaccgtattctgatacggctcacacaccagatccgtagcatccttatgctgtctggcactctgagtcgctgttacccgattttgcagaaattcatcacttctctggcggctgaacactgcatgacggtctgcgctcgtaagagtataggatatatccggctggcatcccagaccatttcctccattttgtacttcccgatcaatgatatttccggcaatacaataactctccggcatatctgaaaccagtgggacattgtttcctcctgttccataccgggctgacatggtaggggccacctcatgcggacctgtatatctggcatcaatcccgtgattctcaaacagaatctggtaattgttcccgccggtttctgcctcctctgtaagggctagatccggagtttcctctgccccagcactcccctgctggatgcccatcaccaaaggcggatgaccactcatccctgcccgcagggttgctgttacatcgaccgaaacatccatacgctctcctccttggtcattgaggcacagacactcttctttttctgcactttcaaacttcctcatcccccctgccacaaaggtctgcatctgcaaattggtcgttgccatcaaagctccggatattccattaaggttgattgtttcttccctctgatcaatatgaaccgcaaaaatatccacctgtttttcctctgctactctactcccgcctgaatccgcagagctgtttccagctgcggcggtaactcctttcccctgatcttggccctccgcaggatccccaggcaggcgttcctgctcaaataatatctttggtgcggtgagtcctccaaaatctgcgacaaggaagattctacggcggcgctgggcgactccccagtattgagcatccaagactctccaagccaggctgaattgatctcccaaaatggcagccccagcagattcccagcgcccggtgtcaggtcgaggcacatgacaggtactgtccttgatatggacaatctcctcgatgaccgcccggaaatcttctccatttgcggaactgaatgctccagggacattttcccaaacgaggtatcgaggtcgaataaagtcatctgatacccctcgtctttcatcctctgctctcatctcctttactatgcgtacctggtccataaacagaccggagcgctcccctgccaatcctttccgtaatccggctactgacaaatcctgacaggggctgcctccgcagattacatccacaggcggcaattttgctccatccagttttgtaatgtcccctacatggatcatatctggaaaccggagtttggttaccctcatgggaaacggttctatctcactggcccataccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttccattcctgaagacagttcacttccacacacccagacttcctcacacaccttcaaaatccgaagccccatatctgttcccagcttcctctcttctgggactccatcatccagcatctgcggatataacagatgggaggcaattggcgtaaccccctggttcatggcataacgacaggctgcctttgcaaatgctacattccgctcaacatctccagaatacggagatgcaatatacaccagtttgttgtgttccatccttcaccgtcctctctacttagaaaccacttgcacaaccgtccttgttaggttcatagctccctgcgctgcatagactgctcccatcacatttgctttggttcccgtttccaacccaaactgccccgcaatccgaggaatctcacctgccgataacataagtcccagaccaagcagtgcctgatccttaacgaccatcagacctgcgatcaggaccgtcgcctgtaaaaatgcggtcaggcacagaccgattacctgcttgcaccagccaacaaatccatcaatatatccccttggcacactgaataaataaaggctccctactgcaatctggatcagcaggatcccgccccgttttaagttcgcaaagaacactttgattaccgcataacccatgaggatcaggagaaaaatcataaaaatcgggctgctgatacttccgattccaccaaaaactccagatgtggcagcttcttgccaggtagcagcatcctgaagagactgcacaatccctgccgcaactgtcccaatatcttctcccaatcctgtaataccagctgtaaaactcccctgaagtgaaatactgagcttataaagttccactggaacagtcgtaaaaaggctggctgccaggaatcctttgattacattcagggcagtatcgcgtatgcttcccctgccattctgatattcaattccgcattcaaaggctgccactacgattcccgtcacataaagtgcccatgccagataataaaaaagaagcacaacagactgtacccagctcatttcgaacagttcagcccccatgcttcccatctgcatgaaaaaatcccccagaaatccaacaatctgaccatacagccagtcaatgatctgtcccagaaccgtgtctgcaacaaaatcccagaggaagttttcggatggaatcttgattgactgagtggcggacgggtgagtaacgcgtggataacctgcctcacactgggggataacagttagaaatgactgctaataccgcataagcgcacgctaccgcatggtagtgtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgaagcaagtctgaagtgaaaacccagggctcaaccctgggagtgctttggaaactgttttgctagagtgtcggagaggtaagtggaattcctagtgtagcggtgaaatgcgtagatattaggaggaacaccagtggcgaaggcggcttactggacgataactgacgttgaggctcgaaagcgtggggagcaaacaggattagataccctggtagtccacgccgtaaacgatgaatgctaggtgttggggggcaaagcccttcggtgccgtcgcaaacgcagtaagcattccacctggggagtacgttcgcaagaatgaaactcaaaggaattgacggggacccgcacaagcggtggagcatgtggtttaattcgaagcaacgcgaagaaccttaccaagtcttgacatcctcttgaccggcgtgtaacggcgccttcccttcggggcaggagagacaggtggtgcatggttgtcgtcagctcgtgtcgtgagatgttgggttaagtcccgcaacgagcgcaacccttatccttagtagccagcaggtagagctgggcactctagggagactgccagggataacctggaggaaggtggggatgacgtcaaatcatcatgccccttatgatttgggctacacacgtgctacaatggcgtaaacaaagggaagcaagacagtgatgtggagcaaatcccaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaaccgaaaggagggagctgccgaaggcggggcaggtaactggggtgaagtcgtaacaaggtagccgtatcggaaggtgcggctggatcacctcctttctaaggaagaagaagtaagggttttatatactgtctagtgttcaatgaaaaggacacaaacaatttctggtgccgatgcgcttaggggaaacacccgtacccatcccgaacacgatggttaagacctaagcggccgatggtactatgctggagacggcatgggagagcaggtggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatacgtaccttgaaaaccgcatattgaatgaaaatgaattgaatattctaaatcagaatatcaagacatccgaggccatacaagagattgtatggaaaaacaaacttgtaaatgcgaaagcgtttataaacaaacctagaaccaaagcgtccaacgctatggacgtgagaggaaccgcagcaacccgccgcggggaatcattttggttaagctataaagagcgcagggtggatgccttggcactaagagccgatgaaagacgtgataagctgcgaaaagcttcggggaggagcaaatatcctttgatccggagatatctgaatggggaaacccggctgagcaaacctcagtcactgcatggtgaatccatagccatgcagggggaacccggtgaactgaaacatctaagtaaccggaggaagagaaagaaacatcgattcccaaagtagcggcgagcgaaatgggaagagcccaaaccagtgtgcgtgcatgctggggttaaggactgcaaacgtgaaccgatttgttagtggaactgtctgggaagtcaggccgcagagagtgaaagcctcgtacacgaaaacaataggaagcagcagtatccagagtaccacgagacacgagaaaccttgtgggaagtcggagggaccaccctccaaggctaaatactacttagtgaccgatagcgcatagtactgtgaaggaaaggtgaaaaggaccccgggaggggagtgaaaaagaacctgaaaccctgtgtttacaagctgtgggagcacgttaaggtgcaaccgcgtactttttgtagaacggtccggcgagttgccggtactggcaaggttaagagcttaaggctcggagccgaagggaaaccaagtctcaaatgggcgtcaagtcagtacaggcagacccgaaaccgggtgacctatccatgtccaggttgaagcggaagtaaaattccgtggaggaccggatccacatccgttgaaaagggtgggaatgaggtgtggataggggagaaattccaatcgaacccggagatagctggttctcctcgaaatagctttagggctagcctcatattagtttagcggaggtagagcactgaattcctaagggggcgtcaaagcttaccaagggatatcaaactccgaatgccgcataaatgatgtatgggagtcagactgcacgagataagttgggtagtcaaaagggaaagagcccagacctacagctaaggtcccaaagtgtgtgttaagtggaaaaggatgtgggatttcaaagacaactaggatgttggctcagaagcagccacacattcaaagagtgcgtaatagctcactagtcgagaggtcctgcgccgaaaatgtccggggctgaaacacaacaccgaagcttaggaatgtacgaaagtacattggtagaggagcattcttaaaggagcgaagcagtaccgataaggagctgtggacttttaagaagagagaatgccggaatgagtagcgagatggaggtgagaatcctccaggccgaatatccaaggtttccagagtaaagctgatctgctctgggtaagtcggggcctaaggcgaggctgagaggcgtagccgatggacaacaggttgagattcctgtaccatgtatcatcagaactgtggggacacagaaggacaacacagcccgggaatgggaataccggggcaagcgaggtaggagtacggttggcaaatccgccgtacaatccgaagacgtgacgcgcagcgaaccaaagtagcgaagtgtgtgattccggctgtcaagaaaagccgctattgtgtgatacatgcccgtaccgtaaaccgacacaggtagatgaggagagaatcctaaggccggcgggagaagcattgttaaggaactcggcaaaatgaccccgtaacttcgggagaaggggtgccacagagatgtggccgcagagaataggctcaagcaactgtttagcaaaaacacaggtctatgcaaaaccgtaaggtgaggtatatgggctgacgcctgcccggtgctggaaggttaagaggagaggttagagcaatcgaagctttgaatttaagccccagtaaacggcggccgtaactataacggtcctaaggtagcgaaattccttgtcgggtaagttccgacccgcacgaaaggcgtaatgatttgagcgctgtctcaacaatgcacccggtgaaattgaaataccagtgaagatgctggttacctgcgccaggacggaaagaccccatggagctttactccagtttgatactgggattcggtattgcatgtacaggataggtgggaggctttgagacatggacgccagtctgtgtggagccaatgttgggataccacccttgcgatattgggtttctaacctgcgcccgtgacccgggcgggggacaatgtcaggcggggagtttgactggggcggtcgcctccgaaagggtatcggaggcgctcaaaggttccctcaggatggttggaaaccatccaaagagtgcaaaggcataagggagcttgactgcgagaccgacgggtcgagcaggtacgaaagtaggacttagtgatccggtggtatgaaagtgggattgccatcgctcaacggataaaagctaccctggggataacaggcttatcactcccaagagttcacatcgacggagtggtttggcacctcgatgtcggctcatcgcatcctggggctgtagcaggtcccaagggttgggctgttcgcccattaaagcggtacgcgagctgggttcagaacgtcgtgagacagttcggtccctatccggcgcgggcgtaggatatctgagaggagctgtccttagtacgagaggaccgggatggacagaccgctggtgtatctgttggcttaccaaggccatggcagagtagccaagtctggacgggataaacgctgaaggcatctaagcgtgaagcccccctcaagatgagatatcccatcgcgaaagcgagtaagaccccttgaagacgacgaggtagataggttagaggtggaagtgcagtaatgtacggagctgactaatactaatcggtcgagggcttatccaaaaaggttaagggaaaaaacctctaacaaggtttaccacacttccaacacccctccgctcaccccctttttcccctccgactttctccctttcagagagagaaaatataggttgggagtacccttacagggggcttagattatcaatacagcaattccctattttcagttgttattatagcctgtccgaaagagattttcaagccctccagacaggcttcttttacagctccatgccgcccattcctcgctggtgctgctgttgctcctgctgctgtccgatctccggatcgggcagcagctccctcgccttttcaagcagaggacgcagacgctccggcaagtgttcttccaagaagtccagcatccgaccgatgccgtccgtcagacgctcggtgaagctgcgttcctcctgcagctcggattgcagataatagttttcatcgcgcagcctccggttttcctgttcaagcctctgctgccgctgcgcttcttccagccacttcttcatggacggcacctgtgaccgcagacgggtgttttcctccgtcagctcctgtaccttgtgccgatccgtcacgctgcgcagtgccattttctttagctgctcgacctgatccaccgtcacgccctttactgcccctgtgagcgtcttttccggctgaatatcatgcaggggtgcatttaccctgtcagcctcctttaagagccgcacagtgcctttcagagcgtcccgctgccgttccagctcagcaacctcccgctctactgccgctgtctgctgctgcaccgcttccagcctcgcagccgcttccttgaactgtggcaagtccatgtgcggtctgttcgtgccgagagagataatttcaaaatcgtgccgctgggcgatctccgtcagagcttctttctcccgttccatccacgccgcccattcggtctgctttctgccgacaccgacaaacccctgctgcttcaatgcctgtttcatagatacccttgtagaaagtcctcttgactgctccgttgccacagggataaaatcgacatggagatggggcgttgcctcgtccatgtgcagcaccatattgaacacccgcagatgggggttgcgttctgcaaaagactccgcaaaatctttcagagctgccgccgcccgttctccgtccggcgtaccgcacccacagtctctcatgttgccgatctggaagatcgcttcatggaacagcttttcctgtttactctgccggatatgctcatagtagtccggtatcttatctctcgttttggttttctttgcgttgtaggctgcgagagcttcatcaaagaccatatgatagacctgcttcagatcctcgttgcagaaaacaatgttctgctccgtccggctccggtctacattcgccgctgagaagctgcggttgttgtgccggatgctccctgcacctgtcatacccgaaatcgtaactcccataaaatcgccccctttccgcttattcttccgtcctctattttatcataaatttccgctaaaaataacctctttgttactttctggtgagaaagtaacgcaaaagcactttcacaccgccaccccatcggtgcagcggtgtgaaagtgctttgcgcccctaaaggggaggggttgccggagctgcttcactgccggctcgtgcctgctgctctgccagctccggaggggcgctgcccctgccgtctgcggacggctccccgaacttcatcccaccgataaactggaagttattttacttgcgttctataaatcctatgattgaaaaaatcaatcctacaatcccaattccgataacgagcagccccattcctgatgagcaaagagaaattataatggcaaagagtagtattgcaatacctaatccaattttcttcattgtaaatcctcctttacaaatcccgatttgtcgttctgtttagtccccaaagaacttactaaaccagctacgcttttgaaccggttctgtctcacgctccggctgatcggctccggccttgccggaaagaagctgctgatgcatcgtcccagcatggagagcctgggccgctgccgcagtctgctgtgccgtcaccaacgccgagctgacctccgccaaccttgcgttcagttcctcgatctgcttgtcctttacagcaagttgctcgcttttccggtctaattctccctgcagcatagcgatcaaagtggtttcgcaagtttcgcaacttgctttcgccggttgcgaaacttgctttcgttcaacacctaaataatgctgatatatggcggttttttgactttcgctgattgcgaaacttcctttcgcatctttcgcaacatggtttcgcctacaccatgcacgaactgcctgttccgacacgccacattctattgcaatttccgttattacacccgccaaatatcatcaccactctttcatccagagttaatctcaaaacaaatcgctatgagatcccgtccttatcaatttcaaaatcaaagtctgccgaacaactttatagaccaacagccagtccggctcgatgtgacattctctcatgtccttataatttctggaattagtgagagcatgatctcgatacgcctccggcaacggctgctcgttacacaacagcgtgatcacttcctccaacttcttcggatcgcagcctctcttgatcgcaagcttgtaatctcgtttgaactgccccgaaaactccggcttaagcattcagcgcctccatcagatctgcaacgctatcaaacggaccatacatatcctctcccttttctgccgcctccatcgccgcataggtaacagcattcggctcgtcaaccttgacttcaaagggaagtccatgacacctaagtgcctgtcgataaaaaatacccgttgccgtactcaaatccattccgagggacttaaagagagctgccgcctgtgctttcagctccggctccattcttatcgtcatatttcctttagccataatagcactcctttcctcgtcatttttagcttgcactaatattatattcaatattcgtgacatttgcaagtgcattgcaaatgttttttgcaacttttctatgaacagtgctttctatatggtaacaccgcagcgtgtacatttagggggtgaaaaagccttatttcgcgcggttttcaagcctcgttttcggtggggtaatataaaacccttacccgccccgaaaacgccttgtagggcgtttctgtggcgtttacagccctttcttaaattcctccaccaacagatcgctcaaagcctgtgatgggcgtattttgaccgttatatgcccctccggtacggtgtcccaccatttgcggatcgttttcggatcaagtccggtgtccctatgacaatcggccttgcgtccctctggatgctcctgccgccacgcatagacttgcgctttcttttcttctgccccttttcttctccatgtgccgccaggataatccacttcctgcaccgcccttgctcttttcaaatgctctttctgtgatctaccattcctcttgttgcgctcgatgcgaacatcggtcagagcttcaatatcggaaatcgtgaaattgtaatactccttgtcgtaggcttccagcgcactccgtatatcttcctcggtcaatgcgttctcatgcttcaccatctgcagatcatcaaaagcctctttcatatcctgccggagctgctgcttcgacacaccgcatttgtaagcatagatagcaaggcacatcaaaaagaaataccgatgcccgccctttatctctccgatctgccgcagccaccaatggtagagcgcatacggatcatcaccatgcacctttccggcaatatcccacttcttgcgtcctttctcgcctctcacaacaacacgctcataccactccggatatgcctccctcgcctcagctcgtgtcattttggatgggctgaaaggcttattgacatccaccctgttttctggctttgcgtaggcgttcagataatccagcgttacccgttctccggtacggaaagcgaccagctccgtcccatgcttgtcattgatgctgcccaccatgcggaagctctgattgatggattgatactggatcgccttgacctgcgaagtgctgccatactcccatagccggaaagtgaggtcatatttcagacttttaagctgaatttttatattcgggtataggtcaatcggctgctggaaaacatagtagatatgcagccctgtccccgacagaacaaggaaagtcggcatcggcaaccggcgcactcgctccggatcgccgccaaagcgcagaaagaggttgcgcagctcggcaagacctacgccatccagatcgaagatcagagcatacatccgctgggcgttctccagcctgttctcctttctgcgatatgcaagaccgctgcacaaagtaaggctgttcccctcgacaaactccatgtaatcctgttcccatgtgtcgttatacatcttcctgcgccggagcttcttatcctcgctctgttcgtcccgatacagatacacagcgttcggatgggaaaaatccgtgtgccgttctccggagttctcattgtccggaaacagctctttataaaactcatagcctccgacctccggatattgtgcgctcaaatactcgtagcagcctcgataattctcggtcatattaccacctcacaaaagaaaaagtaccaaaaagaaaatccgctgcggcggggatcgcctgcgggcgggaagggggaaaagggggagcaaaagagcggcggctacgccgccttaaagagaaagtcacctcccccttttccccctcgctgcgggtcattgaaagtgccgccactatggaaaacccgatgggtttaccacagtggcttggaaaacctctaacaaggtttaccacacttccaacacccctccgctcacccccttttgagcggccagcagtttagacgccagttctccctccagcagagcgcagtccagggtatcctccgtctggggagcaggaaaacgaacatccagatccagctcgtactcacaccagtcccagatagccatgtataccgtgccggagcagttgccgtcggacaactccttccgctggttattttttatcagataaaaggacgcaatctgtgacatggcagttcctcctaaatgttattctttttccatcagcccttcggcctgcaatcggatcacatagaaagcccgcacccagtccagttcctgctccatagattcctccaaagccagaaggcagcgctttccaagcctgcggtccagaagggcaaagatacggacaaggggattctcactgacgaggcctttctcaatgctctggttatcaaagataccaaacgcctcatagaacaccttttggtcaaaggtgccctgctccagcgcataggcataagcccggtcgatggcctcttttgcggagttgtgatctttcagcgttgtggaccgcaaatgatgaaatttcgtccacacattttcaaaataggtgtagtagttgctccgcagcacctctacaccgtccacacgaatggctgcccggccctcatggtcggcgcttttgctgtaactggtggcaaaatactggatgtggccccggagtgctgggcacagatagtcattctccagcttgttccgcattccgctccaggttgacatagcgaccgcctcctttctgctgtttacaggctttgccttttgtggttgaagtgctatccgtttaatctgccagcttcaattctatactggcagtcgatctccatacaagctaaatgtcccataaaatagtcgggttctgcatccaaatcgatgtaaaagccagtttcaatcccatttacaaatactgttacattgtttacgaatagtgcttttacaaactcatcttctgaaattttcccatctacttcaagggctccatcttcgatcatttcattcacagtgtctatgtagtcatcgttttcttccaaaaaagactggatgatcaactctctgtgtgcattgatccaatttatcttttcaaaaacgatatcgcctatatttccttctatgctcttaatctcaaggagaattttggtctttctctcccatacaatcaattctccaacataaaagccgagcttgctgtcaaatacaaattccgtattccccaataatattctatccgacatttcggcgtttttcttctttgaaaacagtctcatatagatccccttaattactgtatattactgcgcccgccaatcccgatagcgcttttcatgtgcgatgttttcagtgctcattgagatacctcgccaatttcttctccagcagttctgtcatatcattgcagagtcgcttgaccttgtcctgctcatgggcgtagtaccagatggtttcctctccgggacagagcaggagttggtcgccgtccgcttctttccagaactcgcccagcacacaataccgctctccatggatggtcagattaaacatcccggaaagggaaaggatcacgcctgtggatacattgatgcccgcagtcagcaggaaaaactcccgcacctgggacgggagcgtgaagcccagcacgctttcttgattcccgatctgctcctccgtggcggcaggctggatctcatcagtggggtccagcacctttgccaacgccttggagaacttggggtagcgtcgaaacagctccgggttgtcggccttgaatttcgcttgcttttcccgctgtactcgctcctgatccttgcagaaagcgtccagctcggccagataccgctcctggtagagattgctgacctcaaatgctgtgccgcccttttccagaatggcgatggctcccttttggctggtcagcaccgggacccactgaaaaccgtgtcggcagggcttcagtttcaggaattcaccccgattgagcagggtttccaactccgtctcatgttcgtcccaccagctccaccatgtttcgggagtttcccgcccctcgaccaagtccaggagttttactgtcaatgattctttgttcataggtgtccacgctcctttccccgccatcacttccacattactcggtagcacaaagctcattcatttttggaatcagtaatttatccatccactgacaaacaatctcaaaggtattgtcaattttttcttcattccctatatcaagatatatttcattgtttcttaaactgtaaaacagtggttgtgtgttgatgtccggtttggcgtaaccataagggtcgtacggacgagtgttgattatataacaaacctctatgcttatgctatcctttgtgttcccgccgaatgaggaaaacgcaatcatatatgtgaaatttttactgtgcctcgtaagtgttttgtcggattttttatatttaaagcctaaatgtccgtactttccttgcaacttatttccaagcatttgcattgcttcgttaaagttcattgtgccccctccatttttccatcgtaaaaataaatcatgatacttgtgattccatgacttcgccatcatcattgatataagtatagtgaataaaatcctcatccacaagcagcaggcaggggctgaaaacctcccattcatcataatcgcgcaggatgtcatcatattttccgaatatgaagatttgaaacagtgcctctgttcccatcaaaaagcacaggtgaacattttcgtgtgggtacgggcaagcttcttgaatcgacagttgccccggctgcgcgaaatcgagttttgagatgaattttccaagtttgatctcttccgcttcatctgcgtaccggtatttttgagaaaaatcttcgatgctttttgtgagacggtccttgtattgctggatctcttctctttgctgctttgctttaagctgcgcttttttctgagccaaaagctctttcctctcatgatccatcgttcattcctccgtttcagagggcgcaggaatagatgctcatggccccgtaatcggtgtgcaggacaagtccgctcttggtaaaggcaaaattcacctgacgcaccacaaagggatcatcaatggtggccagcagttggccactaccggtatcccatacttctatgggggagctgccacgatcctgctgaacggccatcaggctgccccttgtcctcaccgcacaggtatccgaaaaactcagcccctggcggacagaaaacgggaaaggattgtccatctcctctccggtctgggtcagatagaacttgccgcccaccgagaagcactggtcatctggagagaagaagggatgccagccctcattggggatcactactttttgggcagatttcagatcgaccagcacatactcaccctcggtgacgcgccaggccgctttgctctgccggggagagagcatcccgaagcagtaataagcaaaattcgggtcttttgacttcttgcattttactgtttcccgccacacctctgtgttgctgccaaagtcaaagacggcgatctcctcgcccgtgtaccacagggccaggtcgccgctggcatccagcatggtcttcatgctgtttttcttgttggcaaagggcgtgatctcatgggtgtggagagagaactgctggagaagatagctgttgttcagcagcagggtatcattggggcagaggacctgctcataggtcatccgcttggcacccagggaaactgtttcgaggatctccccgctgccatcgaagtgatagaggatctcgtcctcaaaatcgcccaccacccgcgtcaggaagaagtcatcccgtgtgagggcggcagccaggggcataaaaccgttgctgtccttgccgacaaaccgatggcaccgcgcctgcccaacggcggcatccggattctgatagacgaatcctttccgcatctggcccaccatggcgctggccgccttgctcttgacctggaaggcggagtcgcacaggatctccttgaccttcccgccatgggggcaggttcggatggtatgtccgtcaatttcgatccgccactgcttatttgtggcgggattgaggaaggttttttcaatcatggttttgactgttcctcctttcggatcaggatgctttttccctcggcgttgatgccatacaggtcatccaaatggatatgaaatccatcctcacgaatggtttccgccataccaagagcggctttcgccaatagaagcagccccgcccggtttcccgttaactccaattcatttccgtcggcatgagtggtaaaggagaggtgagcttccggttccactgggaggatgggcagttgttcatcattcagttgaatggtcagtgttttagttttcattgcttgtatcctaccttttgaaaactcctcaatcaaaatccatccagaccaggtgctttccgcagtggaggcactggaacagatagcattgcagatgcccgccattgacggattcccggatcattcccttctgctcctcgtcccacatggagtcgtccagcacctcctccagcacacccagtgcccgcagttctctggctcccacattacccaaataggcgcaatagtcaccacaatgggcgcgccagtattcctgctgccagccggagtagccgggggtgcggtggatcaaaacacctatagggggcttatattatcaatatattttattttacctttttgacctcttaaaaaagggcgatttttctctcccttttccctaccagtatagcactactattttttcttcaaaaaataaaaaattatcgctactatcaacatcacaacacctatcgcaataagcaagatgctgacaagaacactattcaactttcctgcgacaaataccgaggtaggaccatctacacctccgattatagcaatagcattattattcatcttcaatgcaacacccacaataacagatattattccaacaacaccagcaacgattcctaatatttttttcattgactaatctcctttctcaaccttccgatttgtcgatttctttttacttaccaagcataccatataacagcataagaaacactaaaatattacagaccataccgccccaaaacaggtacagctttaagccctcatatctgaaaaagctgttcttactttcctccagctcccggatcttttgcttcatcacgctcgtaagtgtatcagactgcttctcaagaagctttgtagccctctgtatagcctctatattcgcctgtaacgcctttctaacctcttggacggtgttttccttaacctcatctttcaaactcccaatctcgcccgatatagcgtcttgaagcaattcgttgctgttcttcagcagctctacgctctgcttcagctcgctgatgagcttcctgttctgctctgcgtctctctgcctgttctgctctgcccttacttgttcttgatttgactgcttcatcaattcctcgcagttctcgctcgacatcgccaacgcttctttgagcagactgttttccagctctgtccggctctgtcggtttaactcttgaagctgctctcttggactgctctgcttctgctgttcgtgcatttctctcaaactcatgctccatgctctcctttccaaaatccatattgtagtatttttccagcttgttatccctgattttacaagccttttctcctgcctgttccctggctaagtcggtatatgtgatgtacttgtggctgtcctgccagtctacgccgtaccctctttcattcatcatccggataaagttttcccggctggtcgctgtttccttacagtccagcaccgcaagggcaatatcctgcacatagcttttgacctttccctgctctgcctgtttcaaaagctggtaggtgtctttgctccatgccaccgtttcttcccggacttctccagcaaaggtctttcctttctccggcacatgcaagccctgttcccggctctgctcgttgcaccgttcctttaggtctttaaggtcgtgcttactccattggagcttatgaccgtcctcataatttacggaattgacaataaaatgcgtgtgtatatgccccttgtctatatgcgtggctatcagaacttcatgccctttccatgcctttgtatgctctgccagctcgacagcgttcttgtgagcctgctcctgggttattttctcgtcctcatggtaggattgcacataatgcttataggttcttccatccgtcttgccccacagctcctttgtggcttgcatttcttccttgaccgtctccggctcacaatgcagaccgctgacaagcttctcctctgtcttttctttttttgtcacataatctatggcgtgccctatgcccgcctttgaagataccgccttaatgactgccatactttgttcagctcctctccatgcttccgcacttccgcttcactcggcaacattcccccctcattacaccgctttgctatctggttgaggttgttccctatccgtttcagttccgggataagttccttgataccgtccgtattcacgatttgcttctccagcacacaggaaaggatatattcctgctggttctttccactctctgaaatcttctcctgtagctgctggtattcttcttcacttacccggaatgatagctgctttggtcttgtcttgttcatacccttaccactccatatccatgacatcaagtaggtcaaagaaacgctccagcgtcttattttccttttctgccggattctgttttacatatttatcaattactttcatcagctcctgcacctcgtatctgtactcaaactgaattttatccatatcttttttcatgcctttgacctctctttcttcggtgctaccaccgtcatattatgagccttccggctcgtttaaaagggggattgaaggggggcttgccaccctcacaagttctaaagtggtaacactttagggaacttgcaatatatccgctacacatattatagcatgatagacaccctatatcaagcggatatattcgtgcgtatattctgccaagaatatagtggagcttacttcctcttgggcgactttggaagtgtaggagggagacagtcaagggcttgttttttatctgcagtatgagcttcggcttgccgatcagcgagtacagcagataaaaaatggtcgcagaccaccctttactttcttccgccggaacggacaatgaagcacagggggaagtaacggaacggacggacagccgttttcccctccggcattatagccaacaaaaaagagtatcaagggtaaacgctgcggtctatgaccgcccttgacactcttttccttatggctttgatgataaacaaggggaaatggcttcttgtggcatttctgcccctgtgatataatgaacgacgctaccgcccccagacaggtagagaaagggggtgaaccgcatgagtgaacttctgtcattttttctctctgttttggcaagtgtagttgcctactacatctgcaaatggttggacggagaagaataactggtagccagccttgggattaagccacccacccagaacggaatagaaaagccccggagttgcgacctccggggctttttgctgtgccacatgagcacttctgtcattttcgcctactggcattataccatatgcctttcggcatttcaagtatgccctacttccaccacttgtaaactgtgggcttgctcaatcctgtctcccgtatgcagtctgctttctttccgtccgggtgctgacgctgccattcttcgacaatcttcgacttttctccgctgccttttggtctaccatttccctctctccaatccctatcctgtcttttcatacgaatatcacgaattgcccttgcttcttctaagtgatcagcctgtttttggtaattccttttattcgctggcataggaatagccgatactctttccgcttcacttcgactatatgtgacataattttcttgataaaactgcatagcgtccattatatcacgcttagtaaaacggttatgctcatcatctgacatatcatcaagaaactgcaatagggaaaaagcgtccgtaaaaagctcatcttccggaatatcgcacttaacggcataggacgccaaaacgcaaaggcagctgtatctatgccctacagaagctccctcttttattttccgcagccaccaatcatataagtcccttttgatatgccaacgctcacggcgctccccttgcacaattcgcttttcataccattccgggtactttttgcgtgcttctgcaaggcttaaatcgctcttgtagtgaaaatctgtgaccgccttgctcttatccatgagataaccgttcaaatactcaattgtcactctttcgcctgtttcaaaagcctttaccgggtatctctttcccagttttgactgcgttccaaccatacggaatccctgaaaaatcccctgatactgaacctgctcccgttccgtgaatgtacttgtatatcggttccagactttcgcaatcagctcatacttgaactctcggagcttatcctgcaaatgcttatacaaagggaccggcttttccagcagataatataaatgcagcccgtgaccgctattgatacagtaagtgcatttcggaataatatcatgattcatttgatggaacacatcacggagctgcggcatctccaccccgtcaaggtctatcgctataccatacagccaccttgcattggctgccgtcctatttctgccggaatacgctacaggggacatgacagcaaactccgcccctttgacctcatcgatgactgacaaatcatcaaatacaatccgattctttgccttatcgttttcgactatagttataatgccatttgcttttccgtcctcaaaatgcccagctctctcaaaacttccctccgggaaaacagcccgataaaactctttcggcttcacttcctcaaaaaactgcccaagccattcatttttcagcttatacaactgcttttcagtcggtttttttgccataagtccaccacctttccccacccctaaaaacacctatagggggcttatattatcaatatattttatctttccgccaacccatgaaataaaactgttgattctgcatccctcctaacatccacaatactcatgaaacatataactgagtcctacgaaaataccggtgacatcccaggttcaaagtccagcttctctgcctgttctactgccttttccagtctttgggcttccctatcaaatcgataaactgaattccccaacttctcctgtggggtcacggcttcctcatttacagcttcaaccatcgcattcagttcagttacgcttacattctctgtttcttttagaataatcgtttcatgaatcgatgacggaatcacgatcaaatctgatcccagcttttctgcaataagagacatcacttcttcgtcacgcatataaaccgccccattgacctaatttgaattcgtcagaacatacatcattgcattgggatccacatcctctaaatattccaaactacctgcttttacatctcccagttcatcagaatacatttttgccagcatatcctgtaaatccaaaaaacaaggaggattgctctgcttcatgttttcccaggcatcctgctttaactgctcctcactgactcccaaccacctcagcctgtcataattaataatggcacttccggccttttctccatccaccaacacatgaaatccataaaccagtgccagatcctctcgtatttcatgaggacagcttgccagaaaatctatattttcctgtgcgttgcggacatagacggtcagactcttctttatcgtttcataatcccattccctgcttgaaatgccatctatgcttatctctgcttcctggcacttctgataatcctgagcaattttctgccacacatcctccagtttctttccatcctcaagttcctgataataggattccagatataaaagcggaacggatgtatagcttttagtgcctggaaggtatactccctgcaatttgatgttgttattttttaacacctccatgatttccacttttctttcctgaaaagattccggaaaaaatcgttttaaattcttttttgttaatttcaaaaattcttcatatgtcattttctattctccttcacacctcattcttattagtttcctccatttgatcatcaagcacgttcaacgcttcccttactgcattttcattccctgttctgtgttctgctgtgtctgtattggaaaatcttcattacgggtaatcattccgtaggttgtctgcacactttccaacagcccaagctgacgttccccatatccttgaaaatcaaatgtagcaaatgctggatcatcaatattgaactccaattcccgaaacagataccttgcatacgaagccatggaatacatctgtggatcataggaataacaatccaggttttccgcaatccgaagagcctgttccaagctatcgcattgctctagttccaaagctgccttgaatttgcaaagcgttctatcatcaggaaattcctgaagctgtcttgccagttcattcaatgtctcaatgtcatctgtctgcttaacggataatccatgcactgtgctgatgctctccgtaatgatacagtcatcaaaagttctctcgtttaatctgttcagcgcccactgaaaccccaaatctgtagttggaagttccaaccaggttccctgttcttctggatattgagatccgaccaggcgaagagaaaaaatccctccggccactccgtcaatatcgggaaggtgaattccatcataaatatcttgatacgaaagagcattctcaaatacataaccttttgaggtaaatatgcccatttcctccttacgctgatccatccccactctttgcggatccaataattctcttatatccacttcaagcatatggatccactctaatctgtcttcctctaggtagaattctcccagtttcctgtcatctataatgcctcggaggaatttaaagcactccaggttataacaaagattgagtaactcttttatcccaactggaacatctatattttcttcctgacgcatctgaatggcggcttcataagtttctatctgactggagtccatatgagtaaccagacaagctaatacattgacttcttctaaggtaacagacgctgccttttccaatatattcttaagaaaagatggccagttccccagaagttcaatccggtaaggctcattttcatgaataaaggctctcatctttgcatccttcaaaaaagcgggttctgctggaagcctcagcttcgccccttgataactccgctctgggaaatatgcttctgaataaatggcaacatccagggctggttttaatgtatgtgccgtccctttcaaaacctcttccggacatacaaagtaatccagtccctcatttccaagaaaaaccataagttctccatctggtaccaggatccttgtctcttgcatttctctgataaagcctccagcagcaatcattccccatgtttctgctaaactctgaacctcctcatgtgtcagtttatcctgtgagtctgcctgcagtacactccataatcttccctcataagcttccagatccagtgataggctaaccggcttatgcagcctctttgcattattaaagtatgtcatcaatttctgatttctttttcccaacaatcctacaccttccatatggtcgcgtataaaagacgaatagttttccatctcataagcggtcagatgaataccttcctctgtactattcagagaatatatctctccttctatggggctgaacaatcgaagggtataaaattctccatcataatgctccaaaaacaatccctcctttctgaacggctggttcctgctcttctcctttcaaaccttcttctgtggtcagaaagaattcatctccactgttccaaaagctgacatacagttctccctctggaattttgattccccgctgttcaaatccttctccccacccatcactttcctgaccttcccagtactcctttactgcttcaatctccctttcagaaagctggttatgactttctacttccagaactccccatagttccccccgccagacttccacggtaggcttcatactgtaaattttttcttctaactttggatccatccgcctttctttctgatgagttttatggcacacttgaaaaaatgcaaaaaactaactagttttttcaaatggaggtaaatactatggataaaaccactcatgaagtaaggcttgctaattggaaatcaattattgagcaatgtcaacagcgaccggaaggacagactgccaaacagtggatgatggatcatgacatcagcgaaaagagttactactactggcttcgcaaaatacgcaaggaagcatatgagcaaatgtcttcaatcaacctaccggctaccagtcaggaaggcactgttacatttgcagaattaccagttcaaccacagggagcttctgaatctttcgggcagtcatttcaagcagatgcaatcatccgcaccgggaagttgacgataggattatcaaacactgtttctcctgaacttctaaaacagatgttggaggtcgttatccatgttagctgaagcagccggcgtgaaacgcatcatattggcttgcggaagaactgatcttcgaaaaggaattgatggtctggcacaattaatcggcacaaagtatgatttaaatccttttgagaaggatgtgcttttcctgttctgtgggtgccgaacggacaggatgaaaggcctgctttgggaggggaccgggtttttacttttgtataagcgtttggaagatggctcattcagctggccgcgcacgcccgaggaagcggcggaactgactagagatcagtaccagatgctgatgcagggcttgaatccgattgttccaaagatcaaagaggtccatccaaagcatgtgttataaagtttttgttgtgcaaaacagagaaatttaaaccttcggtttttgctgtgactttggaatcccaaaacttgccgtaaagctgtcagcattgcggcatatacgcctgaaacaaggcacttttgaacattgaaaactctatatttctatccttgtataagaggtataaagcgtgtaaactataggcattatgacgaagtgccaaagtgccgaaagtggcataaatacgctatctgcggtataataaagacaattaggagagcgaacttatggctgaaaaatataccgtggaacaattgaataagctaaacaaaaaagatctgatgctccttgtgttgtctatgcaggatcagttaacgcagatgaatgataacttggagaaacttatcgagcagatacgtattgcaaaccaacagcgttttggacgccatacggaaacactggatgcagtcagcggacaactatcgctgttcaatgaagccgaagcactttcggaagatactatggaagaattaacgatagaagaagtccttgcgacaatcccaaaacagaaaaagcagcgcggtaagcgggatgcggatttgtctggatttccggaagaaaagattcttcacagtgtctcgcaagaaaaacttaacgagatgtatggtgacggaaactacaagcgtatgccggatgaatcttataagcgtctgcgttacgaaccggcttcctggacagttgaagttcatacggttgaagtgtatgtcggcacagatgggctccatcaggatgaattcgtccggggtgatcgtccaaaagatcttcttaggaacagcattgtaactccttcattggaagctgccatcatcaatgggaagtatgtgaattctattccgctgtaccgaatcgagcaggagttccagcgaggtggtgtccatatcagcagacaaaacatggctaattggaccatcctgtgtgcgcagagatactttcagccagtttatgactatatgaaggaagaactatttaaatatcatgtcacccaatgtgacgaaacaccggttgaagtgatcaatgatggacgttctgcaggagcacagagttatatgtgggttcaccggtctggcgaatactacaaagacaagcccattgtcctgtatgaataccagaagacccggcatcatgatcatccggagcaatactacaaagactttaagggagtccttgtaacggatggtctaagccagtatcatctgattgaaaagaatctggagggggtgaccaacgcgaattgctgggcacactgccgcagatcgtttatgaatgcggtaaaggcaatggatgaccgggaaacagccaaaaaatcggttgcataccaagcactaataaggatatcttccatctataaactggatgaatctttaaagacgcttacagcagaagaacggctcaaggagcgagaaaagaatgtaaaaccgcttgttgaggagtattttgtatgggtaaaaaaagtgctccatgaacaactgccaaaaggcgaaaccgctaaaggtttaaaatacagcatcaatcaggaaaagcagctaaaggtatttctgagggatggagaagtcccgatagataactcggcttctgagagatcaattcgtacattctgcattggcaaaaagaactgggtaataattgactctatcagaggagcagaagccagtgctgtgatatacagcatttcggaaactgccaaactgaataatctgagtacttacaattatttttgctatctgcttacagaattgccaaaacttgcagacaaggatggaactatagacaaaaacgcattggcatcgttgatgccgtggtcaaccaatctgccggaaaaatgccggagaccacgccgctgaaaagcggcgttagtttaagctggggcggatggtttgacgtttacaattgaacaaaatcgctgcgcaatggcctgccaaggctgtggcatagcgattttctgttttctataacaaaagcagtggaaagcaagtcctaaaagtagtattgttaagtcaccacaacgaaacaatcaaacaggatcgaccttcccactgcctatgaaaagaataccacccttccgcttggttggcaagcggttttatgaccccaatgcacctccgtgtaaagcagtgtttttgatactactgattttacatggaggattttattatgtatgaaaaatatttagaacagcttgaggaagctggaaaaatccgcaacctcaaagaacgttccatcaactgctataaaaactatgtctcttactttctgaaatatcagggtaagaatccggaagagcttacctgtcaggatgtcaggacttttttgcttgcaaaaaaagaggaagggctgaaagccacaactctgaacctttataattctgccatccgttttttctaccgaaatgtcctgcatatcctttgggatgatatcaccgttccacgcatgattctggaacacaagcttccaactgtattaacttctgatgaaatcgaccgcctgttagacgctattgacgatatcaaatataaagctatgtttgcaacaatgtactcttccgggatgcgggtttctgaagttattcatctgcattatgatgatatttcccgctcaaatatgcagatacatgtcagagatactaagaaccggatggatcgttatacaatcctttccaagcgttgtctggatatccttacacaatactggtttgagaaaggacggcctcgtggaatcctgtttcctaataaattcaccggtaattacctgacagtcagtacactggagcaggtgatgcgccgtgccgtatccgatgccgaccttccgatgaatgcaacccctcactgtctccgtcatagcttcgcaacacatttgatggagcagggtgtggaacgtcagcatattcaggcactgcttggacatcgtgatccgaagtctacggaagtttatcttcatatcagcaacaaatcactcatgggtatccaaagtccgtttgaccggaaagaaggtgctgattatgaataagccgaccgttcaggatatttttcagtgtttttatccggcataccttgaaaagtattctccctctcctgaacaggcgaaagttgcccggaacatcatgaactgcaaaacaggagcctatggaacaaatatcagtgtatgtgaagactgtggtgctgttcagattcattacaattcctgccgcaaccgttgttgtcctatgtgtcaggctgttccaaaggaaatgtggatggatgcccgcagagaagatgtacttgatgccccctactttcacttggtatttacagtgcctgacattctgaatccaatcatttacagcaatcagaaactgttatatgacaccctatatcatgctgcttctgctacaatcagtgaactgactgctgaccctgcacaccttggtgctgctgtcggatatatctgcatccttcatacatggggatctgagatgaactttcatcctcatatccatacaatactgcttggcggtggtctgacatccaaaaacgaatggaaagacaacggtactgagttttttcttcccatatgggctatctccaaagttttccgtggaaaatatatggatgagttaaaaaatctctggaatacgaaccagcttgaatttcatggcactgctgaaaaatatcgtaaccattatacattcaaagagctgcttgattcctgttatgctgcggaatggattccttattgcaagaaaacctttaacggtgcacagtctgtgattgattatcttggaaagtacacccataggattgccatcagcaatcaccgcatcatatgcatacacgatgaaaccgtcactttttctgtaaaagattaccggaacaaaggacaatggaaagagttgagcatttccggtgttgaattcatacggcgttttttgatgcatgtgccgccaaaacgttttgtcaggattcggcattacggacttctttgttcccgcagcaagcgaaagaaacttattctatgtcgaaatcttcttggttgtcaaaagtatctctcaaaacttcgggataaggagatgcctgaaatattaaaacagctttatggcataaacgtctatgtgtgtaaatcttgtggtggtcatcttggaaaaccacaacttcgaatacctcaaagatgttaaaagattattctttcatattttttctgaagcctcaaagtttgaggttttattgtcgtacctatttatctggaaacacctgatttctgtagattctgcactgaaaatcctgtataatcatgggtaagaacaaaagattgaaagtccataggtagtggctacccggacgctcactttgttcaattaggtcaaatcgaaaatggtgtaaacgaaggggcagttcactggaatgccaaaactgctttttcgtttaccccatcattgattctaacctaaagaatttgtcgtaggaaaccgagaaatgggcccagcccgccgcagatattgcacccgccgtcaccgccgcaggtggtaagtctatcagcctgcaccacttcccgcatataggggtcgtaggcgatggacaggccgaagaagttgggttcctccatatcatagggccggttctcatcctcatccatgtcctcaaaccagcgtagacgcatggagtagtctaacccatctccccatgggaacagggtccgacatccgccgccgcacaggtaggcccactcgtccgccgtgggcagcgaaagcccctgcttttccagcccggtaagaagttcatcgtagtctgtgcggttatagatccaggtctgaaatccatcttccgtccgttctatgcgggccgactggtgcaaggtaagactgctgctgtcactccaggcaaagtcacggaactccttcggccagtcagggtgggcggtcagcctgggatcgtccatcttgactgactcccagcagagttcctccagctcccggcccaccagcatggggccaatggccgcttgccggacgagagccatgctctctccgatgagttccgccgggttctgctccatttcccattctcggaacagatactccaattcctcccggctctcctgattcagtccctcggcaaactgctcccagcccagggtgacggtatcgccggggacaaagacgaactcccgaccatctttcttgaagatgccggtggtgcagttctggccccagcggtcaaaggtatgtagaccgagaaaggtcatatcataacgagcagccaggctctccatcagcacctgcttctcgatgttttccatttgattgaattgggtgcggaatagtcttttgttcataacaagtcctcctacagcctatccaggttttcctgtaaatcgccctgcatcaagtgctgggcaatggcttggttcagtgccttatgggggtgataggctgcctgctctacatcgtgcaggcactcctccatcaatgcctccggagaaatgccttcccgtttgccataaagatggccgaaggcatagcacacggacttgagaaagtcgaaaatatagtcgtgatttccacgcatactgggcaggtcgttgaacgagcccatacctccgtatgcccgaagatggtgggcaacctcccgccgctggttccagtcctgaatgtcccgctccaaccagtcgatccagttttggaactctggatggtctgccagaaggatggagcgcagacaggtcagagcctcggtataaatatcagactgtttcattggccatcgctcccccaaatacctccatagagcacaccatcttttccaaggaacaacatccggctgcgaagcaggctgcactgctccacagcgaccttgtttccgtcacaggtgggaatagcctcctgttttttcccaaggtgatcaccatgagcggtaaggaagtagaatttatcccgttgctggtatccgccttgaaacaggaaggtattgccggacggggcaacagaaaaagctccgcttccttcgattggcagttcaaatacaaagtcctctttgaagttcgtccgcaccagccggaattcatcgtaataataaaaccacaggttttcttcttcgtccaggctgatggcgtagcagtcatagatggaatagttctcattcttccagagaggagttccctccgatgtccatgcaatcaggccgcaagcacccaaaggttcatcccaaccgtaattaccaaatacaccttcgtcaaagtagctggtaatgatggtgccatctttttttaccacacagtcttgaatgccatcccccaggcagaaacgggacagcacagctccgtcccggctgacgatccaggcgttctggtcggggccgttttcccgataggcgcatcttgcccccagcaggaggaagtgatcacctgcgggccgcaaataatgaaactggaacttcaagaggccaagaggaaacagcgtcgtttccagcacccgctgttccgcccaatccagctggatttccactgcggtataggtggaaggagtgctgagccagtccttaccctgtgtttcggacggctgttccatgagaagatagacttttccatcccttgccgtgaaaaagtctgtcacttctgtgccctccagatgtttttcccggcgcagctggtccaggtcaatgatggagaacaacggcagatttttggcttttataggtttgttcatagtgtctcctcctggctactttaacgctccatcataggtgtggctttcccaggcggcctcaaattccgcctgctctatgacgcaggcgtggaactcctcaccccagacatgggcgttcaattcctccacggtggggatcggcgtgatctcgatggcgccgtcgtaaaggtcaggaatattgtctggaaatgaggtggagggattgcggaaacggatgaaagagatactgagagacaggcgagcctcctcatttcccatgaccatcgggattgttctttcgctgattattctgatgtgtgggattagtgagtatttccggcttcaagtcattgcggcaggtgtgcgggaagccgtggaggatgctgtcatttccacagtcaatgataattatgcaggtgtgtatcatggagtcagggagggatattctggcagctatgttccatttggagagggaagctgggaagaagatctgaatgaaggggacatttatgattatctggatgaaaccatagggacccaattgtctggtggcaggcatgtaaagtatgcggatactggaactgcaatggagtttgccatagatagcctgcaagtgacgcttcggaatgcacctctggccccatcggatccagcccatgcgcagcggtttgaggcagatgccattgttagactggaggttccagttcggtttggcggccggattcttccatccatgtggatcacattgaaggtacaggctggatatacagaggtgttctagggaatgacctggactttgagaggattgtatagtatgttgtgcataacaaaacaggataaaggaggagcagaatcatgaaactgacagagaagatgaaaaagaatctggcaattttgggcggcgtgctcataggaatcggcctgatcgctgccattggaatgcagtttggtccgaaaccgtccggtgaagatgttctgccaggaacaggggagacggaaacggaattgattgtagatcctggagattttgaaaagaaggaagaggaaagtaaagtagtatccagagaagaagagagccttgtgattcatccaggaatcggagaaaatcaggaaacagacactcaggcggtggacagccggtcgccacagactgatcagacaacgcagagtatccaaccaaaaccaactaaaccagaaccgccaagcaaggcgatcctgacagatccaacacaaaaaccagatggtacaaagcaggatacccctccggttcccgtggatcatgaagcggtagaaaaaccgtccgaaccggtagcagatccggaacagccgcaggcaggagatacttccgggaaccagatctatgttccaggattcggctgggtagaaaaccatggaggaggaggctctggaactgcagcagaagatatgtatgaaaacgggaataagattggcattatggattaagacagaaagaagaagcaccacatcaatgtggtgttttttcttttcccagataccagggaaggaaacaaggcttcctgtggttggaaaggaggatacttgaaacagaagaaatgtgtgtttttcatagtctcaatcttactgtctttgatactctccatccaggtttatgcagtaggggacggaaatcttgatgggggcggcggaagtatgggacaggggaccagtcagaattcatggtcaccgggaaatgaaggggtgcgggttactgtcattcgggcagagagtcatgatccggtaacaagaccgattgacttaacaaacaagcatccgaatattgcctactcctttgggaaagtcagtaaaatgtcttataccagaggaagtgctttgatgattgataccaatccatatgagtatgtaaatccggcacagtctctacccagaatcatcagctcgaaaagtctggggcaggcaaatattgagcagattaaaagttattttacagatgaacaggtggtgcgcagcattgcaggactgactggaatggattttgacacactggtgggaggggagtataggctcttattggagccgatcagttttcttaaatttcaaggaaccctgattgcagttacagcaacagaggcagcgctctatgatgagatgttaagtggtgggcttcgtgctgtccttccaacagtggcatttcagaatctaccactttctatgtttttggaaacaccggatctgggatatccggcttggggaggtcctacatcgggaatccgttccaacagtgaaataaaaagttccctgggacttggcattgtacggtttcgggatgtgccaccagaggaaccggagatcacgacctatgattatgagtataggactaacacggaagtgattacggcagtagaggtaagcggaggacagagtgatccggatcatccggtatccgtaacattttccgtaggaggaagaagctatgcgcgagtggctcaggggtggagcaccaccttgccaaggtgggggccgcgggttcgaatcccgtctcgcgcttttttgttgtttaaccggagttttgtatgttttattctgcaaagcggccggtttttttgtgctgtttaaaatttgctgtccccaatcatgattttaggttcttgtccccgcagaacagaagtatattggaagtatgagaataaaggaggacaaccaatatgagaaaatgttggatgatggtaatcacggtgttgcttatcactgctggggcgagtgtgaacgcatttgcagggcaatggaggcaggatgataccggctggtggtatgaaaatgaggacggcacatatttaaataatggatggtcctggattggcggaaaatgttactattttaatatggatggctactgccttcaggatacgcagactccggatgggtacagcgttgacgcccaaggggcctggaatgtgggcggaacggtacagattcaggagcagacccaggagcaggtgccggaacagacacaggaacaggctcaggattgggctgaagcaaagcagattgataatgtggtagtcacagtgccggatgggtttgtatttcattcctcggatgaaagaggaatctatctgattggcggggaaggcggcagccttatctgtgtcatgtcggaatccctctcggactttggaggatatgccgacctggtatacacatatcaggaaaaattgctggatacagctgtggaaaccgagctgggcacccctcaatccagaacaaccaggcagcttctcagcggacaatggtattgttatcattacatggatgcatcctcactgggtataccgggctttttgaaggtttacgccagaatccatggaaacagactgcagatggtcatgttcggaggttctatttcagctctggacacagaagaaataatgaacagctgcctgtgttttttgccataggcagcttgacagcaggacgaagttatagtaagatgcaagtgaacacttgcgtttgcggaggcatgatatggatcagacagggcagaatattatagatgcagctatggagctggtgatggagagaggatatacggctaccaccactaaggatatagccaggagggccggggtaaatgagtgtaccatcttcagaaagttcaagggtaagaaagaaattgtgcttcaggccatgggacagaagagatggcatccggatttggaaccggaagacttcatgaattacacaggcggtctgacagaggacctgtgcaggttttcacggatttacatgaataaggttaccccggaatttgttaagctgtccctgggactgcgtacgccggagctggcggaggatacaaaggaaggcatcctggctattccgctggtttttaaaaatggccttatggaatatctaaaaaagatgcatgagcaggggactcttatatccggcgattatgaaagcatggccatgatgtttttatctctcaattttggctttgtgttttttaaagcttcttttggcccaggtttaactgagatggaagcagatgagtatattggaacgatggtagatgtatttgtccgtggagtaaccaggtaagtacttaaatatatggtgcctgttggtgccatttatttttatcaaacatgcaagtgtatacttgcacagaaaggagaaggtatgagctgttattttattatctctgtttttttggaaccaggaaaggacaggacggattacgacgattacataagactggtcaggcccattgtggaggaatatgggggaaggtatgtggtgagaagtgaaggaatcgaatacatgggaaaggactggcagccggaccgctttattataattcgatttccggacagagaaagcattgacctgtgtttttcttctaatgcgtacaaaaacatcatgagcaaaagagagaatacagtggacagccgggccatcattgttatggacggagaaatgtatggggacgaacgggaaaaaggaaatacagaggaggagaaaatgggatgaagatacatgaaggagtccatcagatgcgcatttcgtttaatgtcacacctgaaatttccagatacgtgcatgtgtacgttttagaaggaaagaagggatgttacctgattgatgcaggggtgaaagactaactattaaaagtcaagtctaaaataaaagttttggatgaattgcagaggcaaagtgacgaaatttaaaatttaagaaatagcgtattttgtggctatgtctagaaacccggcagtaaaaggtggatatctttttctgccgggttctgtgcatgttcgagcatccacaaatcctttgatttgccgaatctgtgtggacaagatgcctcatctttctttgatttacgtgcgatttttagaagttatacaccgtcatttttacgaatcgagaaaaaccggcaattcgccaaaaagccttatttatgctaaacttgaggtggaaagtgaggccgcaaaatgaagaaaaacgagactcagaaaccgatatctcttgaagaactgctgaaagggctcagagagcaaaatgaatatcaggcaaagattatttctatgcaggaagataccattagcattcaaaacaaacagaatgaggaacttgccgaaatgttgagcagagtgctcggaatgattcaatcgggagaataaacttatgaggatttcctttgaactggttacatctttacagtacggtctcagagcggcgcagcaacagcttgcgtcatttaagtccggtcagaaatatgtgaacatgaaaaaggaacatgaaacggattgtcgttgtctggagaaacagataaaatctctgcaggaagaactgcaccgactccgtctggaacaacgctctgcccgtcagcaatggtttgaaagcacagatgacatgcaggcagagtacgaaaagaagatacgtgcctttcaggcagagaatgcccgtctctatgagcgaagcttcaaggcggaagcgcagcgtgatgatgcatatgataagataacgcaaatgcgcagggagaactatcagcttgcaacagaactggaagaagaaaaaggaaagaatcaaaagctgattgctcagattaacaaagatttccaaaattcctctttgccttcttctgctcagattatcaggaaaaagaagattcccaataatcgggaagcaaatggcagaaagcctggtgcacagccagggcatccaggccacagccgaaaaaagcagacccccaatcagacagtattgctccagccatcacaagaaatccttgatgattctgatttcaaaaagaccgggaagactgtcacaaagcaactggtcaatgtacagttatgtttaaatgtaatcgaatacaaagcagatgtataccgtgacataaagacaggagaactctaccacgcagagtttccggacggtgtagccgatgatgtcaactacggttcttccgtcagagccttcctgtttctgctgaataacgattgctgcgtttctatcgataaatgtcgggatttccttaaaaacctgaccgacgggaaactggatatttcaaaaggaatgattagtaagctcagtaaagaattctctgaaaaaagcgaggcactgcgaaggtctgcagtttcagagatgttcctttctccggtcatacatacagactgtaccaatgcccgtgtaaatgggcagagagcgtatgtgtttatctgcgcagcaccagacgggccagctctatactatgcccgtggagccaaagggcatgcgggtgttgcaggaacgcccgtagaggactatcaggggattttgattcacgaccatgagaaaaccttctacaaatacggctctgcacatcaggaatgcctggcacatgtgctgcgctatctgaaaggcagcatagaaaacgaaccggagcgaacgtggaacaaagacatgcattccctgcttcaagaaatggtccactatgtaaacggagtggaatcaggtgaagaacgagattccgtaaaaatccacgaatatgagaccagatatgctcaggtcctgaaaacggcctcgagtgaatacgaggatattccgtgcagcgactactacagagaaggattcaatctggcagcgaggatgaacgtctaccgggatgcacacctgttgttcctgcatgacagcagggttcctacaacgaataacctggccgaacggctgctaagattcataaaacgaaaacagaatcaggctatgtcattccggagtatcaaaagtcttgagtttctctgtgatagcatgagcgtgctgtttttgatgcgccaagaagatggtaacctatatgataaagtatccgcagtattcggatagaagaaagaactcatggcttcgactgcttccagtctacaccatgggttctttctttacaagttagcctctgaacagtaacggatctccctttataggctcgtaaccgatcttcagggtcatctgttcctctggcagagagacaccggggctgcgggtgatggtgtgcttatcgtccgcagaaaaaccgatggtctcgccgtcttgcagcgtcacatcacacgccagcacataggaggcaaggcttgccaaaaagtcccgtagttcctccggctcagcgtcggtgttcaacacctccatttcctccttgccaaacacatccatgccgtaggtgtagccgtttaggcccccctcgctccggtacaggccgaaccaaacccagttgaagatgggcagttcgtcctttttgagcatatcggcaaggccctcatagaaacgaggctcaaataccacgccgctggtgtagacaccggtggcgtatttctgcttgcagcacactgccatcgccttggtgaacagcttacctcgttccagcagtttttcctcctcgcccaacacagccaccatgatatgggccttgtgcgctttggccacttctacggcctctggccacatatagttgttttcggcgttgatctctgcttcattgtccgggatgtgaccgtggaatagtgtcacaatcagcatcatattgccgacccgcattaccacagcgtcatcgctgttctcaacatcttcgtcgccctcatccggctcctcatctacgataccccattcttcccgcagatctcgaatcaactgctccttgtcccactctgctttggagaggagcacagatccggcaaaggaacccttatggtcggtttcctcctcgtcggcgtcatcctcaagaccctctgcatcttcatccggatcatagagggattcatgctccagtccgcggataaattcctcaaagctatctgccagatgggtaattttatagtcattttcctgatccacatggactaccgcaggctctccctggggaccgcaagcccggtagtccaggaaaatcatatcgtgtccggcgcttggacagtcacagatggccacaccgatggcaggatactcccactcatcgatcataaactgactgcccagctctccacagagggagcagctcttttcccgtccgattccgaaaatgccggtgatggccacatgatcatctgaccaacaggtaggctcatcgcagggatagcaggtgttcaccggaatgccgccgttgtgctgcttcatcagccagatgtaggcggcgggcagcttgtagcccagttcctcctccacgctggcaatcagctcatcggaaggcggatcactgacatattctttcagtgcataccaattatcatcccagaagttggtgaggtcgaagccctcaaatggggtatcaccaggcacgaatttggccttctttttccggctgcgctggcgtttccggatctccgccttacactcccgaattaccgccggggcattttcatcctctgggtccagctctgcccaccgctgggcgtagggaatggccttttcctcctggccgtagagatactgatagccataggccatccgcatattccactctgccttgtcctggccttcctcccggacggactccaacacctcaatggccctcaggagggctttgtctcccttggatttcaaagtaccttcgtcatggtccccgatgatggcgtagttctccagcgcccgtgccagggcgtaggcggtgcggtagttcctccaatcctccgggatggcattcagtgcctggatacagcgggtgtactcgtcttcgtcgttccactgctccagctgagcgaagaatgcttcggcgttctgttgggtgtaaggaatatagtccatgcccgtcagcgtttcgtccaactcgtcatcctgattctcagtttctgtcccatcatcttgttgctttaggggtacagaaccggcttcacggcggaaggtgtggaagatggcccatgggatgtccgtgccttcaaagaactctttcgccatgttcagcgcctcttggatgtcccaggcgatgaagtccacatagccacagtagaggccggtagccccgccggtgagagtgagcacttccgaggttctttctggactttgggtattccttataaaacattagctggtatcggttcgataccagcttgttttataacaatgcagaaagtgaaaaatcctgatttttaggaagaaaagccaatttacatttcttctccagattgactaatccgcttctaccatatacaatacgtttgaggactttgaatttgttgttgtttccttcaacaaatccagagcttacagaaagggatatcgcattcttgaccggagtgatatccttttttatgccattgcagaaagattccagcttactctcaccatacttttctaaatattcatccagttttgtttcatcccttcccattaacaatgcgtgaaattctttgaacatggtttcaactttttctacaacaggataaaggctttttatctggctgatatatttttcaatatttgagtcacgtttcttttttggattacaggtcaaaatatatttgagcaaatccgtcctggtgattatgattacttctgatggcagcacccactccatcgttgtttttgcattaaacggggttctgtctggaaagttgtttttcccaatcagataaatatagtctgcaagtatgtgctcagattcgtgaaataccttttgccgcttgatataaaaataaatcagttcgttgctgcagccatcggccatcatcttgtaaatgacattcaaccatacattcatagatgattcccgttttttataatgattgggattgtccaaacgagaaatatcttcttgggtcatagccagatatctctttgctgtcaataacgatattccaaacgtttctgttatattttttagccgtggtttcttttgcttgtcccagtattcctgtatgtcccggattatttgctgttttttttccgcatttcttcatgatgttggtattgtgctgagtttaaatcatgctttttattatcataaagcaactcgtttccgtcagaatctctgggagaggtattatcatagtgcaggctgtcaagcagggagttatccggagctttttcccgcagtattttatctggtgcattttcagataccctttcgtcttgaatgtatagtttggccggcatttcctctttaaaaatatctttcatatattcaagaagattttgcaataaatgaaaccggtcagctacctgaacgcagtccggcagtatttcactgatagcagaagcatatgcgtttgcccggtctcttgcaacaagccgtactttattatgtgatttcaaccattctttcaatggttcaccatcacgtccgtccagcaatgctatcaaatgatgatccttcaagtcataaatggcagtagcatatgtctgaccttttcggattgcgacatcgtcaacaccaattccttccacatccggattatctacgaattcgattctgtcgtacagccgctgtatggtatcattactgatttgaacaccgagcagggccaatactttacttgcaccctcattactgagaaacattgaaacagcaaggaccaacgtattaagagcatctgtgcgtacctgggaagcttttgcaaatgggagatcctccataaaaaccttacattcgcagtcaggattctcgcagccatatttatacacgtttgcatgtaagaaagtctgcttacaccggataggggtatcctgaaatttccttctgtaagtagaatgaagcttgtgactcatttttccacaaataggacagcaacagccatgttctttcgatttgatatagatatgtaagctgtcttcattttcaacatggtcataaacgtagtgattttcatctaacagaaaagaataatcttgtgtcggaaaatacttcaatctgttcatcttctttcatcttttgataactctattataccataaatacccaaaaataagaagtgattaggtaaagaaaaagtagatactctcgtatctactttttcttgtaatacccaaagtccagaaagaaccagagggaattccaaatgaatgccctggtgtcatcacataaaccatggccggaacaatttttccatccagttcaatctccagcatctgcttatcatagaaattcggatacccttcataaagatccagcaatgcctcgtctttcttctgaatctcccagaccagtatcggcacagtactccctgctttaggttctacggttgccacagcccccctgcggcctccccgaaataacagttcgtaatcctttaattcactctttcctactaccttcgcagtcggacaacgaaatgccatctgctccagattcagattgctcccataggcaatataaagtctttgttttcctttcaatttgcttcctcctgtcacattcgcatacaaaaagccggggattcctgtgcttccccagctgattctaattcctcaattggatgaatggtttcctgtctctggatccgttctgccaattccttctcccgcttctgtcgcattctttccttttgtgcttccgcctgagccggatccttccaggcaatacagcccggcagatttgccagcagatgttgacgagctgtggcgaattcttccccatttaatcctagccgtaaaagccaagtgcggaatgtatacttctcattgctggtctgagtttttcttctgctggcgcaggactgattcagcgcttgggcgccaatcgccagacaaaactggatataggccttaatcttgcctgcatgaagcgtcccattgaacagacgaaattccactgttcctttctgaaaaacagaatgaaggttcagacaatgatagcggctatcatcataatgctggtctctgcggctctccccgttataccagatccgttccactgcctccatactctttggttttcttctgtttaattcttccaaaaatcgtgtgtctactggctgacaccaccgatgctgtcgatccacggacacccccagagctttatagatcagatcttccttggctgccatgatattagtgatattacgaagggttctggcatcaaacggttccgcattgatatgcacatggataccgcagcttccattcgtcagtgccccatgctctttcagcttccggatgatctcctgaatcgtcacaatatcctcatagcgacagatgggacttaccatctccgtctgatattctctccctgcattgatctttctcccattcgattttttctgcgctgttatactcccatcactcataaacttccactgccgcccctccgtgtcaatggctgcataggtatcgtaataggttcccagatatttgactctagttccaaaatactctgccgttacctcagccgctttcgcacgggtaatgccggtcatctcaatctcaatgccaaatttctgctcctttaactccattcatagtctccccttttagcgtcctcctgcctttccgaacagtctggctttgtgttccggggcatttaccattaagttatatcgctcatttccacatttatacaggcagactccccgttgtggataccggatcaggttatactcactatcctccagctgcagggtatccgtataaaacttggcatcaatgctccccgcattgaacagaaactgatgcgtcgggatggaaaacagcggcttggtatactccctcacgccatccagattaaaatcctctaggttctggctggctatgataactgcagaatctttttttcgcacacgcttcataaaatttctaacatactctactgcagtcaggttggaaaggaacacagtccatgtcatcgtcctcggcttcttccttgcgctggccggtcaattcctccagaaccgcctttccgtccttgatgggagcggagagcatcttctttcgatactcctctactgttttgaggtcaaattcgtagaagtccgcattgtgctccggatcggcgttcatcaccagacactccaacagcgtttcatcatccgccttgatgagcacgggaacaaagccctcccgtacccccagccgctgggcgtagctgtatgccgacatgatggggtcatcatctgccatggatgggaaataggtacactcgcagtccagatactccatgatggcctgagcaacctcggaaggctccagcgtatcctcgtcgaagtcctgtccctgccagttttcaaaccgttccccgatcacctctgccatagcctgatagtagtcctcgtcaaaggggatgaacaggtatgcctcctgctggaactcattggagtgataccgttccgggccgaagaagcggagggcattgtcgtcaatgtcggcgggatagtagggactgtcgccctctccgtagtaatagccggcaaaggcgcgaccttgctgattgaacagcacagagaacaggcagccgtccagctcatcttggatgaatgccctcaggtctacgctggcagggtcggctttgacctgtttggccacttcgctgtattctttcaggaagtcctcacccatcaggtcatgctccatgcaccagcgcagatagatggccatgtggttataagcattgatggggtcaataggcagttccttctcctcaatgctctcaaggtgataggaagcgtcgtccatctcaccgtcaaaatcatcattggaaagagtgccacgagtgatagcatcctggcgggtggggttgaccacaaagctgatgccgttcattttgtccagcagggcgtctgcgtcatgggccagcttatattccaattcatcccggtagagggggatcacctgatagaagttgacctcctcgccgctcggaaggatgcagacttcgctgccatcttcggtatcctggggaccagtcagaatggcggcgcacagctttgtgtcctttgcaaaatcctcctcattgtccatggtatggccgaagcccagccaggtatcgctggcaatgggaaggcgggccagggttttcagcaggcgaatgggccagtaccaccgctcatcctgcatagattcctgaaccaacttccagtccgcaggcagcgcgatagccagctccgcccgctccagcttgtattctgccagttcttccggcacattcatccggtgagcacccatacccatggtgaccagggtataatagtcccgctcctcagtgggcggcacgatgcagatgtccacatggatgtccggggagaccaactcgtggaacacattctcgaccttaccgaaatactgctcaatgtgaccctcgacggcctccatctcctcctctgtgtagacttcgggattactgaattcttcctcatcctgtgtgtcatcattgtctgagtggtcgcagctgtcatcctctggatctccctttataggctcgtaaccgatcttcagggtcatctgttcctctggcaaccggtctcgcatccaactgtgatttcataatccggaaagattcttctatcctccacagattgtggtaaaccgcgtatatttctgaagcaggcatattgatttctgacgtcaccatcatgttataaccggcaagccttttggcattttctattgccttgtcattcatctcaactttgattttaccatcggttttcattccttttttatctgcagccacaaaggaaacgtattttgcgctgtctccatactcggatttttttgcttcgcatgccctgagtgcctttgccttttccacctgtttgtttatttcatagttctgtttttcagcaagtttgggattataagttaccacacgtttttccctgagctttatggactttctgcgaccgtttccatcggtgtaagtatagacgaaatcatccacacattctttcattcggtaaagtacttttccatctctgtttttgatatcgatataattattttccaacagaacccaggtcttttctacctctggcagcatctttacagatttagagaaaatatatccatcaccagctttcaatgcgtggagtatgttgtcaatacagttgagccctttgtcagccacctggatggttctgccgtttatgtgattgcgctgcttcaaatcatcaatgacggttcggattacgggtttttcgctttcgttgccgggatacatcttcatgccgattggaatctgatgcgcatcgagcagcaatcccatgccgacaatgggttctgttttgttctctttggaagggcctttatggcgaaaatcgtcttcgcggtcaatctcaaagtaaaagttggtacaatcaaagtaggtgtgcgaagtatcaaacttatatgtcagctcaatctgatgattatagatttcaatgatcttctcatattcagagccgatgtattcaaggccggaatagagctggtcaagagagaagtcatatttgccaaagagcttgggaatgacttcatcataagttctggattttgaacagggatggacgcctctggcataaatgagggcggacagcatgtcaaatacattgaagcggaaatcagttgccgtctgcatcaagtccatatattttttacagcagagagcgtcgttaagatttttcaacggaaaatagcccaggagtttttcgggagattcctccgatatctgacgctttttttcctggtgtttactcttgtggtattcctgattaagtttgcgaacctgttcgctgtaaaaagcaatcggatcctcgattccattcttcatgagttcgtttacatagccgatggcttcgtgagacctgtgtgcagtctgcttttttgcagagtcataaaaactctcataaatctgaaggtaaatacccttcttgagattggatttttttaaaaagtaagccataagaatccctcctcatacattataacaccataacaccattttgtaaagagatataaaacaatttagtcaaatttttaaaacacaaaaaaagccagcaactatgctgactgtaaatatatgatgtgttgaattgcccctaaagaattatggtgttaaagcctcgtattataaagtagtagtgtttatagactctctccaaggtctgtatgctatactgttggagatactgtggattgtttatcaccccctaccacttgatggtttatgaaaggctacaaccacagtctctttgtatagttgttaatcagttagataccgcatgacggtttatttagaacgaggttacaatcgcaaagagtaccagtggtcctaaacagtatcaaatttttttaaggagattggttatgatttacgtaggaattgatgtcgcaaaagataagcatgattgttttatcataaactcagatggagaaatattatttcatacttttactatctccaataatcatgaaggctttaacaccttatttcaaagaattgaatctgtttcagatgattttacaaaagtaaaagtaggactcgaagccaccggacactacagttacaatcttctgggattccttcttgataaaggtttgccgacctacgttatcaatccgttacataccaatctttacagaaaaagtctaactcttagaaagacgaaaacggataaagttgattcccgtaccattgctactatgattatgtccgatatgaacttaaagtcctactcagatatatcttaccacaatgaggaattaaagtcactcactcgttatcgtttcgataaggtaaaagaacgggcaaaactcaaaacctctatttccagactggtaaatatcctttttcctgaactagaaaaactggttccctcacttcatctttcttctgtatatgctttgctttctgaatttccgggagctgcacagatcgctgcttcccaccttacaaaactgactaatctcttatcccaagcatcaaaggggcgttatgggaaagagaccgctattctttttcgtgaaactgctagaagctctattggctctgttatgcctgcaaaatctctggagctgaagcacaccatcaaacttattcaagaattaacagcagagattgacgaaatcgaagtagccattaaacagatcatggatgaggaaatccattctcctatcctgacgattcctggtatcagttaccgaatgggtgcaatgatccttgctgaaatcggggactttaaccgatttgattcagccgatcagatactcgcttacgcaggtatgtctccctccacctatcaatcagggcaattaaataactgttattctcacatggaaaagcgtggctcacgttatcttcgatatgccctttataatgccacaaagtatgtttgccaatgggatgaatctttcagtgcatatcttgcaaaaaaaagatcggaaggtaagcattacaatgttgccttatctcatgctacgaaaaagcttgtgcgtctaattttcgcaatggaaaaatcaggacgaacatatcagccagcagcttaactgattctgtaaatatctcctttcagagtgccagcaatgacactctgttcgtcatgcaattttcaaggtacaaatatatctgaagtgcatttctgcaattcatccaaaacttttattttagacttgacttttaatagttagtcttttctttccgccaacccatgaaataaaactgttgattctgcatccctcctaacatccgcaatactcgtgaaacatataactgagtcctacgcaaataccggtgacatcccaggttcaaaatccagctcctctgcctgttctactgctttttccagtctttgggcctctctatcaaatcggtaaacaaaattccccagcctttcctgtggatccatggcttccgcatttactgcctctaccatcgcattcagttctcttacgctcatattctctgtttcttttagaataatcgtttcatgaatcgatgacggaatcacgattaaatctgaccccagcttttctgcaataagagacattacttcttcatcacacatataaaccgccccattgacctgatttgaattcgtcagaacatacatcattgcattgggatccacatcctctaaatgttccaaactaccggccttgacatctcccggttcgtcagaatacatttttgccagcatatcctgtaaatcaaaaaaacaaggaggattgctctgcttcatgttttcccaggcatcctgctttaattgctcctcgctgactcccagccacttcagcctgtcataattgataatggcacttccgtccttttctccgtccaccaacacatgaaatccataaaccagtgccagatcctcacgtatttcatgaggacaatctgcaagaaaatcaacatttttctgtgcatttcggacatagacggtcaaccccttctttatggtttcataatcccattctttactggaaatgccatctatggttattgccgtttcctgacacttctgataatcccgagcgatgttctgccacacatcttcaagcttctttccgttctcaagctcctgataataggattccagatataaaagcgggacggaggtgtagcttgggctacctgacagatatactccctgtaatttgatgttgttattttttaaaacctctctgatttccacttttctctcctgaaaagattctggaaaatattgttttaaattcttttctgttaactgtaaaaactcctcataggtcattttctattctcctctacaccttattcataccgttttccatcttataaacagtcagacgagtaccttccttcatactattcaaaaaatacagctctccttccatgttactaaactatcgaaagatataaaattctctatcataatgcttcaaaaaaaatccctcctttctgaatgtcgggttcctgctcttctcctttcaatccttcctctgtggtcagaaagaattcatctccactgttccaaaagctaacatacagttccccttctggaattttgattccccgctgttcaaagccctctccccacccatcactttcctggccttcccagtactcttttactgcttcaatctctctttcagaaagctgattatgactttctacttccagaactccccataactccccatgccagacttccacggtaggcttcatactataaatcttttcttctaattctggatcataccttgacccgtgacagcgagaatgagaggcagagagtagatcagattgcactccttgatatggcgctacgctttaatccggacattattgtggtaggagaaatgcgtggaccagaagcgaatgcggcacaggaggctgccagaaccggtgttgcggttgtgacaaccatccattccatgagctgtgaggcaacctaccgccgcatggtttccctgtgtaaacgtgctgtggatatgagtgatgagactttgatgggatttgtaacggaagcctatccgatcatcgctttctgcaaacagctggaaaacaaggaacgccgtttaatggaaatcatggagtgtgagattctggcagatggaaccagacgataccgtccgctgtttcaatatcagattacggaaaacagggtggaggatggaaagtttgtaattgtggggcaccatagacaaatcaacccaatctcggacagtctggcaagacggctgatggagaatggaatgccgcaggaaacgctggcaggacttttgaatgtaaaaaaggatagagaggaggagaatgaatgacggcgattcagctattggcgtgtgcgggaatgatcgtgggtgtatttttactgctgggaatgaagccagtggagtttacggacagcctgtttggatttctattgaatccaaaacgaagtctgcgggaagacatcagggaatcatcaggaagaaaaaaatcagggattttgcgcagggaactggaggaagcacagaacatccttcaaatgacgggcagggggaaccggttttccatcatctgcgcagttgctctggcactgttttgcgctgggggatccattgctattttgttggggaattttttcctggctccggtgatggcagtgggttttttatttctaccattctggtatgtgaaactgactgccaatcattataaaagggatgtgtctgcagaactggaaacggcgctttcggtcattaccacagcatatctgaggacagaagatattgtgacggcggtggaggagaatacagcatatttaaatcctccagtgtccagagtatttcaggattttctcatccagattaaaatggtaaatccggatgttcaggccgcccttcggattttgcggggaaggattgataatgaggtgtttcgggagtggtgcgatgcggtcagtgactgccagcatgaccggagcttaaagactacactgccgcccatcgtatcaaagctgtcagatatgcggaatgtgaacgcagaactggaatacatgatcgcagaaccaagaaaagagtttatgattatggttgtgtttgtagtaggcaatattcctcttatgtatctgctgaatcaggactggtatgatgtactgatgcatacggtactgggacagtgtattctggctgccactgcggcggctatttttatatccgctggctttgtagtgaaactgacccgtcccattgaatacaggaggtagctatggaaggcttgttgtttttattcacagaagctgctattgcctctctatcatcaatttcatgactggattttggaatacgatctggagaagattgaccagatgttcgctccagcaaaagaatgactgcataacagaaaaggagacattgctatgggacttgatatttacgccgggccgctgacccggtactattctcacaactggaaaactgttgttcagcagtgggcggaggaaaacggatactctttcaaccgcatcaccccggacggggaacctgctgataacgaggaagaaatgtccccggctgaggtccaggcggcggtggagaactggcgggatcagatcttgagcgccatttctcagccgggccagcccccctacgctccctggcttgaagataatgagaaaccttattacaccgacaagccggattgggatgccttcggcgctatgctgctggtggccgcctgtcgtacatacgaggaaccggtgccttccaccgtggagaaggactggatcttcggggagcatcctctggtcgcccgccttgcatcagatgaggagcgggtgtggtccctgtttcgtggggctacctggtggctccctctttctgacaactttctgttccaagggtccttgcctaccgatgacaccgccgctatcgccaccttgggcggactgcggaaggagctggaaaagctgaaccagctggcgtggcaggccgatgaggacactatccttggctgggcagacacggagggatacccggtagacggaaccgtagactcagatggacagtacagcaaggcagacatcccggaacacacccagtatgacactcaatcccttgccaagtttgccttctccatgttctggcgggccatgcggtttgccgaggagcagcaggtgcctatcctgcttgactattaaagagaattcgtcagggggtggagaccgtggaacaaaaacggccggcagatataattcaggaacttctggactacctgtggaacggcctgggcctggaggaaaagggctggaagcgtctgaaaaagggcgacttcaaaaagaaaatgaaaaacgggctgacctatcagatctggtttgaccggagccgctacaactacatagactacgaaatcggccatgggaatgtggaggtgggcttcagctgtatcataaagcagggagatgactacctctactctttcagaattgaacccacaacaggcggttcattctttcggatgctgacagaggacctgcggctgaacaccgagctgctggacacctttctgcccctgatccaagcccactaccttgactttatctctcgctttgaggtggacccagcagaggcgctccaaccggtctgcgccccctttatccagccggaggattacagctggtgcattcatgtgcacagaagctgctattgcctctctatcatcaatttcatgactggattttggaatacaatctggagaagattgaccagatgttcgctccagcaaaagaatgaccgcataacagaaaaggagacattactatgggacttgacatctacgccgggacgctgacccggtattattctcacaactggaaaaccgttgttcagcagtgggcggaggaaaacggatataccttcaaccggatcacaccggatggagaacctgctgacaacgaggaggaactgtccccggctgaggtccaggcggcagtggaggactggcgggatcagatcctggccgccatttcccagccgaaccagccgccctacactccatggccggaggacaacgagcggtcctattacaccgataagccggattgggatgcctttggcgctatgctgctggtagctgcctgtcgtacatacgaggaaccggtgcctcccaccgtggagaaggactggatcttcggggagcatcccctgattgcccgccttgcatcagacgaggagcgggtgtggtccctgtttcggggcgtgacttggtggattcccctcaccgacagctttctgttccaaggccctctgcccaccgatggtcagacgatgatcgccaccttgggcggactacggaaggagctggaaaagctgaaccatctggcatggcaggccgatgaggacaccatccttggctgggcagacacggagggatacccggtagacggaaccgtagacacagatggacagtacagcaaggcagacatcccggaacacacccagtatgacacccaatccctggccaaattcgccttctccatgttctggcgagccatgcggtttgccgaggaacagcaggtgcccatcctgcttgattattaaagagaattcgtcaggaggtagagaccatggaacaaaaacgcccggcggacatctttgcggaggctctggactacctatggaacggcctgggcctggagaaaaagggctggaagcgtctgaaaaagggtgacttcaaaaagagaacgaaaaacggcctgacctacctcatctggtttgagcggagccgctacaactacatagactacgaaatcggccatggaaatgtggaggtgggcttcagctgtaccataaagcagggagatgatcgtttctactctttcgaaatagaaccgacaacaggcggttcgttctttcggatgctgacagaggatctgctgctggacaccgggctgctggacacctttctgcccctgatccaagcccactaccttgactttatcgaccgatttgaggcggacccggcagaggcattacatccggtctgcgccccctttatccagccggaggattacagctggtgcatccatgtggatcttctatgataataactgggctgaaagttctttcttggaccttcagtccttgtattatatataacagcaactactgttgcatgtcaagagcaggcgaaaaatccgcctggggaaaataggttggattcgcttattcaggcagccgaccctcatacatgatgcttagttctccatatacctgcccccaattcctgattggcatggaccatttctttgtggcttcaaacgttgacagctacaacgctttcaaaagtgctgtatcgcttggaaacacgcttctctggcggtttagcttacggtacgtgccattcaggctctctatcgcattcgtggtataaatgacctttctgaccgctgtggaaaatttgaaaatcggggagatggcatcccagttctgcttccagctcctcatggaattgggatatttcccgctccacttttcagtgacacgttccattgcctcaagtgctttttcttctgtgggtgcctgatagattgtcttaaggtccgcgcagaatggcttcctatccttgtctgacacatatttcatcgtattacgcacctgatgcacaatacagcgctgatattcggtctttggataggctgccgcgattgcctccttgataccgctcagcccgtcagcacagaggattaagatatcttttacccctcggtttttcaggctgtttaaaacagacagccagtatttagaactttcattttcgccaacctcaatcgtcaggacttctttgcgtccatcctgattaataccaaggaccacataggccgcaagcttgcggatgatgccattatcccggacggagtaatggattgcatcaatgaacaggaccggatatacttctgagagcggccggttctgccaatcctctatctgtggtatgattttatctgtgacatcagaaataaagccttcggaggcttcaaacccatagatatcttccagtgtatcggaaatctgccgggtggtcatgcccttggcatacatagatatgattttctggtcgatatcggagatatccttttgacgctttttgactacctgtggctcgaaagtagacctgcggtcctgggggaccttgatatccatgctgccatagctgctgttaatccgtttggctttatagccgttacggtaatcatcgctgtcagaacgttccgacttttcatagcccagatgctcatccatctctgcttccatcatttctttgattgtgccaccaagcaggtccttgagtgcagactggatatcctctgcagattggatgtcgtattcctgcaggagctgctggatgatgctgcgttttccttctgtcatttgtacctggtgtaccggtttcttttctcttgccataataaaaggcctgacccgtcccattgaatacaggaggtagctatggaaggcttgttgtttttattcgggctgtttttagctctgggacttttctttttaactgcgtctgttctaaagttacctaccatgggtgcggcgaaggccatgctgggtacggtaaaacaggagcggaaagcggcaaagacattggaaacttattttatgatcctagcagtgcgactgtctggtttcatccggatggatgcatataagagaagcaggatgcagaatgtgttaaaagccagtggaatgaatatgaccccggaagtgtatcaggcgtatgctctggtaaaatcaggcgcagttcttttgggagcgattccctgcatatttctttttccacttctagttcctgtcgtggttgtgctggccttacttctttactttaaggaaaatcagaaagcggatgaaaccttaaaggcaaagcgggaagagatagagggggagcttccgagaatggtggcgactatggaacaggaactgaaagcaagccgtaatgtgatcggtatgttggagcggttcaaggggaatgcgggaccagcgctgactggagagttagatattcttctggcggatatgcgttcctccaattatgaagcggcgctgacacgattcgaggcaagactgaactcgcccatgctgtccgatgtggtacgtggattgattggtgtccttcgaggggatgacagcacagtgtattttcagatgctggctcatgattttaagcagatcgaactgcagagattaaaagcacaggcacagaaaatccctcctaagatccgtgttttttcctttgtcatgctggtatgttttctgctgacttacctggcgattatctgctatgtggcattggagagccttggaggaatgttttagacaggaaggaggagaggatgaggagtcatcgtttatggagagcactgtcagaaagacggggcgaaggatatgtggatgtgatcgtgttggttttgtgtgcggtcatggtgcttgcccttgccatgcgtgtgcttccgatttttattcagaaacagcagttggataccttcgctacagaactggtgcgtgaagcagaggtaagcgggcgcgtaggtacagagacaagccgccgtgccgctgtgctgtcagaaaaaacagggctttatccggacattttatggtccagtcatggaagaatccagttaaatgaagaggttaccgttaccctgacgatggatacaaatatcggtctgtttggcgagtttgcttcttttccggttacgcttcgcgcacaggcagctggaaaatcagaagtttactggaaatgaggtggagggattgcggaaacggatgaaagagatactgagagacaggcttgtatgagacaccccttctgacacttccggaggggcattccaagaatctgccctcaaccagtcaatcatctgctgaagcttcacatctccttgttccggaagatggttccgtataagaccaatggcatccagcccagtatcagactcaaacgcagtaattccccaacatcccatgacatccctcctaaattccgagaatctgccagatataaagcggtgcagttagggtaaataccagacaggcaaacagaattgcaggtgctgcccattcaaactgtccgtgcttccgataatcaaagtatgccgttcccagttttccaaaaaagaacacggcaaggatcagatctatagcgggaaatacaacatgatcgacaactgttttaatctgttgggatgccgtctgccaagttccctcaatcgcaccggctacatcgcccgatgcatataccggaacgcagaacaaaactaccagtacgaataccatgcacataactgctgaaattttctttgttctcatttatttttcctttctactaagattgtgtgagtttcagccccattctttgctgtctttcaagaagaggagccaattcgataatatccggatgttcctgaaactttagatctccccgaaagccaacttttaaactgctaaaccgctttgcctcctcctgcaaagaagtaggtgcatctagtggaagttcctgattccaccgaacccattccccattttgaaaacgtggctgcaatctcaaaatcacataggattccggaacaaatacaggataataccttaatactcctccaactccatagtaaggcttcccttccatcatcactgtcttttgcattaattccagtgtatcctctaaagatgtacaaaaccagcactccttatcacccatccttcgtatcctgccatcccgcagaatatcttccaaatggtcacgggttgtgtaatgatacaaaaatccctttggtttctccgtctgttgatatgacatacttcctcctactctggtttctgtggtgcgatatgccagtcactccacaagttcccatcaatggtaatagaatcattcagattcatggagagcattccagccggtgtccagcaatccagcagccaagtatatggcgtataacttccgtccggataccaaattggtgtaaaatgcgttctcctctcataggtactgtaaccatggtttcagactacttagcttggctagttatctttaaccttcattacttggttttgttctgaattttctcaaatccaaaggtctaaaccagaccttttgtttttagaattttcagggttttacatactgtctaatcttcaattatcaaggttctttgttgtcggcttgttcagcagcaacttttatatcttatcacagctgcaagtgtttgtcaacaactttttttattttcttttttcttactctcttgcgcctttggtactcaccgcagcgcaagagatatcttaccagatgcttcaacaaatgtcaacaggttttttcaacttttttcattttttgcgctttcctgattccagccccctattatccctatgattttctttgtttcaccggcttaaatccgacatgacagaacgcataaacaggggatttttcttatattcggtcaaattgctttcctcacagattaattcaaacagctcttggggacttccttcctgcatctgtcctctgtgtgcctctgtacactccctgattttagagattcgcaaaagtccgtcatgaatcacggatttacctgtactgctgtcataaaccttgtcccatgccggacaatacagttccacgcccttcagttcttccagacgtatcaatgtagtctcactggccagggagtcttcgtaaatcagagcatccgttggctccggtatggcatccccggtaaagaggattttatgttccctgtagtaaaaacacaatgattccctggaatggccaggcgctcctattacctgaatggtaatccccggctccagctccagcaggtccccatctgacaatacccggtctaccggcaccgaaccatccaccagactataatagctgggaatggggcgtttctcatactgcaggtcaatatcttcaatccaatcccgttcacccctgctggcatatacactgcatgagtaggtgttctttatggatttcaaggcgccaatatggtccggatgagagtgcgtcaacagtacagcatttatattttctctgttttttccaaatttatgtatatattctccaatttttttatcacaccctcgtattataaagtagtagtgtttatagactctctccaaggtctgtatgctattgggcgcgccagtattcctgctgccagccggagtagccgggggtgcggtggatcagctcgtccagcttctccggatcgtctacaccatcgtccacagagaaatcatcttgaaaactaccgtcatatttccgggctgcttcgccgttggcgatgcactctgggcacagatatgcaatatcctccactgaaaagaacggattggcatagaaaatatgggtcgtcttgccacagcaatcgcagacaacgccgtctgcggattcctcaaaagccccagtttccagaggggttgggtgataccggaaggcgggcaggcccagctgggcctgccgttccttctctttctgcttttcctccggcgttttgggcttggggagagcataatgattgccccagttttccgcatagtccttcagcgtgcccagccgcttgagggtctttttatcggaacgatttccgatttggcagagcagttcataggcatccttcttgaagtccagtagatcatacacatccaccagcacttccttggcctgctgatcctcactctgctcaagttcttccttgaaggtatatagagcgcggacactgtccggaccttcattggtcgcaacaaactgtttttttagttcgatataggttttctgatattctgtcattggtcgcacctcccatcaatcccaccagaaataccagacggtggactgccacaggacatctgccaaggagccaatgcttccatcctcattctgatccagatctgggcagaagccatattgctccacagccacctccatagctctttccttggagatcggagttggaagttcaaactctaattcatcgtggctcatggcggcagggatggcaccatgttgctcgaaccagtatttcgccactgccatcaggtccggtgtgtcgggacactcattccaatttccaaagggcaggtaggcgaagatctcccaggggttctttaccggaattttagccagaatgagcggatatgtcattccggtatcatcgttccaatagtttgcgaagcggtcgttgggttctccgccctccatctcgcccaggacttcctcatcccagtccagatcatcgtcctcggcttcttccttgcgctggccggtcaattcctccatagctctccagataggcttccgggtcggtggagagctccaggccctgctcccgcagtttgtcgggcagctgggacaggaggaaggacggctctgccttgggttcctccagcacatcaaagctgtctatgtatctcatgtgggggatctcacccagcacctgatcggtgagggtggtgagcatccaccaggcccggccttcttcctcccggagcataggcagcagcttttcgcagtaagcggagatggcgaagctgttttcaccctgctcctccagccagatctgcacatcctccccggagatatcccagccgtcctcggtgcgcaggccgatgttctggaggggctgacggcccaccaggatgttccagtgctccagcacctccttgggggcgtgcttctggaagtagaccagctcaaacagcttgaccttgtcgccctccggggtgaggatcagctcatgctttttgccgttgaagcccatctcgaaagagatctcatcaaagaccagattcagggtttcctgcatttgggccacgagttcggcaccgcgggtgtgatctttgtcctcatccatcatctggcgcaattctgcttccatttccgcaaaggtttcccaccagtcctctgtccgctcccggaagcactcccagaactgcggcagagaaatacccttcttgcaccgttcgataaactctttggtgtcatcgtcaccagggcggacttccaatgccttttcaaaatatcgcagagcccggccctcctgatccagataaaagtaagagtaacccatgcggaagttccagtaatagtcgtcctcgaagtattcctcatggggctttagcagagcgagggcctttttgagcatttctttgcaagttggcttatgtgggtctgccagattgttataggcacgggctaactcactgtccatctcaggggtacgctcctcggcggggatggcctccagcgcatcaataattttatgttgtttgctctcctcatgccacttctggcactgcttcaaaatgtccatatcgaagatatgtatgaaaacgggaataagattggcattatggattaagacagaaagaggaagcaccgcatcaatgtggtgttttttcttttcccagaaaccagggaaggaaacaaggcttcccgtggttggaaaggaggatacttgaaacagaagaaatatgtgttttttacagtctcaatcttactgtctttgatactctccatccaggtttatgcggtaggggacgggaacctggatggaggtggcggaagtatgggacaggggaccagccagaattcctggtcaccgggaaatgaaggagtgcgggttaccgtaatccgggcagagagccatgatccggtaacaagaccgattgacttaacaaataagcatcccaatattacctactcctttgggaaagtcagtaaaatgtcatataccaaaggaagtgccctgatgatcgacaccaatccgtatgagtatgtgaatccggcacagcccctaccaaggatcatcagctcgaaaagcttggggcaagctaatattgagcagataaaaagctattttacagatgaacaggtggtgcgtagcattgccggactaaccggaatggactttgacacactggtgggaggggagtataggctcttattggagccgatcagtttccttaaatttcagggaaccctgattgcggttacagcaacagaggcagcgctctatgatgagatgttaagtggtgggcttcgtactgtccttccaacagtggcatttcagaacctgccgctttccatgtttttggaaacaccagatctgggatatccggcctggggcggtccgacatcgggagtccgttccaacagtgaaataaagagttccttgggtcttggtattgtacggttccgggatgtgcctccagaagaaccggaaatcacgacttatgattatgaatatcggacgaatacggaagtgattacggcagtagaggtaagcggcgggcagagtgatccggatcatccggtatccgtaacattttccgtagggggaagaagct
